United States Patent 10,888,096 (BIOPESTICIDES FOR POTATO LATE BLIGHT DISEASE) - sequence listing, part 8

SEQ ID NO: 14 - DNA, 4477201 bp, Pantoea sp. OXWO6B1 (residues 1,492,402-2,984,802 of 4,477,201)
taataacattgaatcggccatggttcatgccggtgtggataaccatgagcaaaatggtgccttgctaaaacattatgtcagtcgcttacttaagcgcccctctgcctgaatcccctttttctacctgtaaaagtgcgatccctgccttattcctgggcaaaagtgatcgacgttgcctgtcgcgtgccagactgaatagtgtcttcatcacaatggagtaaagacaatgaaaggcagttttatgatgatggtgttagcgggaatgctgatgagcagcaatgtcagtgcagccgataaaacgccgcagcagcaaaaaatggccatgtgtaatcaacatgccagttcgcaagcgctaaaaggcgatgtgcgtaagcaatttatgagcgattgcctgaaaaaagacagcaaagtggctgacatgtcgccacaacagataaaaatgaaaacctgtaacctgcaggccggtgataaaaagctggctggcgatgcgcgtaaaaccttcatgagtcagtgcctcaagaaaagctaatacgatgtcggccatttcggtggccgcttcattctgttccccgccctacatgccggtcacacttttaatggctgattaaacaggccgttagccaaaaaaatcgacatcaggacctaagcctctgcgatcctttgccacacttactgtttataagggattgcgtagcctgtgattatgcgctgcgctttcaacagtgacggtcggaaaaggagccatgtcgtgaactatcaatttgttgttgctctcaagaatttaccgcaacgtcagccagtcaaaaagaagctcggtgaaacggagctgttactgatccgcgagggtgacagcgtccaggcttttcaggccaaatgccctcacgcaggtgcgccgcttgagcagggtgccatctgtggcgacaggcttatctgcccctggcataaagcggcatttgaactgagcagcggtaaaatgtgtgagccgttggcgttggctgacctgaaacagtatcccctgcgaatcgaaaatgacaatgttctggttaaccccaaagcgatgtcaccggcttctcccatgggcagcggtgccacagaaccggtctttgtggtgctgggcggaggcgcggccgggagcgcggcgctgtggcgattacgtcacgatggtttcaaaggtcgcctggtgctggtggagcgtgagccggaagccccttacgaccgtacggcgctgacgaaatttgtgccgtctggaaaaatggatattgacgatgtaccgtcgctgcttggcagtgacgtactggatcacgtcgagcgtattcagaagcgggttgagcgggtcgataatcaacagcatcgcctggtgtttgccgacggcaatacattgcagttcgacaaattattaatcgccacgggcgcagaacctgtgaaacctgaactggctggcgctgatttagccggcgtgcatattctgcgtaacaagcagcacacggcagcactgctacaggcggtcgatcaaagccagcagattgtcattgtcggcaacagctttattggcatggaactggcctcgtcactgcgcaaccgtgatgtcgacgtgaccgttatcgcccgcaatccgttaccctttgcaaaacagtttggtgaggcggtcggtcgttatttttatgaattgcatcaggcgaatggcgtgaagtttgtggaaggtgaagccgcgtcgcttcagggtgaaaaccacgttaccagcgttcggctgaaatccggtcagcagattgccgccgacgtgctgctgttcgccaccggcgttaaaccggccacgtcgtttattcacgatctgccgttagtggaggacggtagcctgcaaaccgacgagcaattgcgcgtagcagaaaacgtctggctggcgggtgatatcgcgacctatccctccgcgcaggggccgcttcgcatcgagcatttccgcgtagcagagcagcagggccagaccgcggcgatgaacatgatggggaatgttcatcactatgaccgcgttccgtttttctggaccgcgcattacggtacccgctatgaatatttaggtcatgctaccgactgggacgactaccagcaggtgggatcgctggaagataaggtctttatggccttttatggcaaagaggggaagctggcggcggttttctcgtgcggaatgtacacgttgacggcggcgcttgttgaaaagatgcagcaaccgatgacaataaaacaggcacttgagctgtatcaggcccagcgttctgcagaatagcaggccagcgagacggtctggcaaacggcatgtttgccagacgcgccagatttaactgcggctcagcttgtccgacttcgccatgcactgttgcatggcttctatcacggcggaacgaaagcctttttcttccagcacttttaccgcttcaatcgtggtgccaccgggcgaacagaccatatcttttaactcggcgggatgtttgcccgtttccagtaccatctgcgcggaccctttcacggcctgggcggcaaagcggtaagcctgcgcgcgtggcataccgcccgcgacggcggcatcggccatggcttcgataaacataaacacgtaagccggggcggaaccactgacgcccaccaccgaatgaatcaggtattcatcgaccaccgccgcctgaccaaagctctcaaatatggcgaccacttcatcggtttcgttctgttcaaccagaacgttgggcgtgactgaggtcatgccttcgcccaccagagaaggtgtgttcggcatcgcccgaatgattttacgatcgtggcccagcacggaagccagattatccagcgtgacgccggcggcaatagaaacgaccaatgcgtctttcttcaggctgttagccagttctttgaggactttgaggatgacattcggtttaaccgcgccaaacagaatatccacatgctgggccagggcctctgcactttccgcggcattaataccgtactgctcggccatttgctgattggtgtctggtttgcgatcgtaaatccagatagccgacggtgtaatttgtccgctgtttatcagcccgccaatgatggcctttgccatgttgccaccgccaataaatccgattgtcttgtccagcatcaccgtctccttaactgtcactgtttcgcctttatcaacgatgtagcttactgcagacaggattaataacaagttagcggtcacagacaggcaccggcacccggcggtgggagggcgggaaagccgaacgctatcgccgcgatactgccccgcacgcgggagtgctctcaagcggctacagcatagggttccgcgagtcaggcccggcaaatgcagcgtgttttggcgggcagggcaagcgctgtccgcctggcttacgcgccaaagcagagataagctgaaccctgagggcgcggggaattttacttaacccccttttggaaaccaggttaccatcgtcgctattttccagcagaaggaacaaccatgtttatctgggtcgatgcggacgcctgccccaacgtcattaaagacgtgctgtatcgggcggcggacagaacgcaaaccatggtgacgtttgtcgcgaatcagtttttacgtgtgccaccgtcgccctggctgcgtacgctacaggtgccggccgggtttgatgtcgcagacaatgaaattgtgaaacgtgtgcagatcggggatttagtgattacggcggatattccgttggccgcagaggtgattgaaaaaggcgcggcggcgctcaatccacgcggtgagcgttactctcccgcgaccatacgcgagcggctgacgatgcgtgattttatggacaccatgcgtgccagcggcgtacagacaggcggtcccgccgccatgagcccgcgggaccgccagcagtttgccaatgaactcgacagctggctcagacaacggcgacgctgaatcagacgaaactgtcgtcatcgtcgtaatcattgccgccaaaatcattcaggtcgccgttatcggcataggtatcactccagccgttactttgatcaaggaatgactgattatcagcgccggtgccctgatcgagaaacgactgatcgttgccgccgttaaaggtattgaggctgtcgtctacctggggcagcggcggctgctcattaatgatgttgacgatttcctgcggctgcgactgatggaacatgctggtcagcatgtcggccatgaccacgccacctgccacgcccactgcggtttgcagtgcaccacccaggaaaccgctgccgcgtggcgcaggtgcgctggcataaggctgctgtggttgaggtggctgctgcggcgcgctgttccactgaggctgctgctgagccggttggggctgctggctgcctccgccaaacaggctggataaaaatccaccgctgctcttgggctgctgctgctgttgcgcctgttgctgagcaagacgattttccagctcctgaacccgctcattcagttttttaagtgccgcttcctgaatcaaaatggcctgagccatatagtagggcgcacctggttgctcctgcaggtgttgtttgatcagttgttcggctgcagcatcgcgtgccgcagtctggctttcagcttgtttcaaacggctaaacagattttcaatcagttgttgttcttcgcgttgcatgatgactctccggttgcgactgttaacagtatatgggggcgatgagccgcaatgtaaattcgtggcggtaagcaaatgttgctgacgtaaacttttttgcctgatgcacaaaatgtgcatgggtaactgcctgtatttcattgtgttgtcggagagcagggcgcaatcatgcgtaaaatacgctcaatgagtagagcgcgaaataaattcccgctatgatgcgtcctattattgagcctaaccagcagctgtgatgggctgcgcggcggaggaactgccctgatgtctttgtccatttttttgatcggtgcgcgcggatgcggaaaaaccaccattggtgaagccctgtctcaggccttgggttacgcgtttcgtgataccgatcatcacctgcaattcacgacccaacgtaccgtggcggaaattgtggcggcggaaggatgggaaagctttcgtgcacgtgaaaccgactcgcttaaagctgtgactgcgccctcaaccattatcgccacgggcggcggaatggtactggcagaaggtaaccggcggtatatgcgtgagcacggtcaggtgatctggttaagtgcaccgcctgatattctggcccggcgtctggaaagccagccggaagccgctcagcgaccgaccttaaccgggcgtccaatcgctgaagaaatgagtgaagtgctgcgcgcccgcgcccatctgtatcaggctgccgcccatcatgaggtgaatgccatgcaagcgccagaacgcgtcgttgagcagatactgcagtcgttatccctggcgcgtgccagctagccctcagatttatccccctttggccgccatttccgccgttttgactatacttaacccatgacaggcggtcgcctgtcgtgtggaatgtcattcagccaagagggacacattatgccgacaagacctccttacccccgagaagcgcgcgttgtgactgtcgaaaaaggccccgaaggcaaaaaagtcatgtcctggcaactgcgggccgatcatcctaagcctgactcgttaatcagtgagcacgactctgagcaggaagcgcatgacgcaaaagcgcgttatgaagacgtcgaaaaagagtaagccgtcgctctggcaaggatgccatcggtcctgctttttttcttctgccagccttcgccgcgtgaggatcacaatcactcactatttcacgtgacagatcagcaagttcccttctacactgccagacaccttaatgtgctgtgaggaagtattatgctcaatgttagtgagtattttgacggaaaagttaaatccatcggttttgacagtgcgagcaccggtcgtgccagcattggtgtcatggctgaaggcgaatacacgtttggaacggcccagccggaagagatgaccgtggtcagcggctcaatgaaagtgttgctgccgggtgaaacacagtgggcatggtttgaggcggggtcggtgtttaacgtaccgggtcacagcgagtttcatctgcagataggcgagccaagcgcttatctttgccgctatctgaaagactaataaaacggccgcatgtctcctgcggccgattgttttaacgctgggcttcgccacctaaggcttcaaccagattgctggtcagggcggccagttcgctggtcatcaggataaagtctgcatcaaaacgctgcgcaaaatcttcccggtcaatatcatcgttctggtcgcgcaaggtatcgctgaacttcaggcgtttcaccgaaccgtcgtcggataacacgaactgaatacgctcctgccagtcgagcgccagtttggtcaccagcttgccggcttcaatgtggttggcaatttcatcgcacaccagatcctgtttcttgcagcgaatcacaccaccatcttccagaatggccttaagctcggcttcatccatcagggcaaaaccggcaggcacatcacccgaacgcacccattcggtcagggtaagttcaatcgggctttccagcgtcaagggcacaaccggtaacgatcccaggcttttacgcagcagggccagcgtatcttccgcttttttcgcactggcgcagtccaccatgatcaggttgttgacggtgtcgatccacatatacgtctgactaaaacgactgaatgcgcgcggtaacaggctgtgcagcacttcatcttttagcgaatctttttccgtctttttcagcttgcggctctgttctgcttcgagcttgtcgattttggcttccagcgcctgcttcacaaccggagaaggcaggattttttcttctttgcgcgcgcaaatgacaatttgaccgttgttcacatgggtcagtgcatcgctgcgattgcccatcggggacacccaaccggtcttgctcatgtcctgactaccgcagggagagaaggtgaacgcatccagctgtttttccatttcgtctgcggacaaaggaatgtcacgattcagacgataaaccatcatatttttaaaccacaacatcgggattccttaccgtggcgcgatcgggcgcacaagtctcactaagtgtgcgcatgatagcgaaacatcggagcggtttcattgcctttcaggcaatcgccttttagtgtagaaaacaccttaacgaataatgaggaataaactgtgcgtataggcattgatttgggcggcaccaaaacggaagtcattgcgctgtccagcgaggggaacgcgctgtttcgtcatcgaatttccacgccgcgcaacgactacccggcgaccgtacaggctatcgttgatttggtgcgtctggccgaagaaaagaccgggcaaaccgggacggtaggcttgggtattccggggacgatctcgccttacacgcagcgggtgaaaaatgccaactccacctggcttaacgggcagccgctggacaaagatttggcgcaggcgctgaatcgtgacatccgcatcgccaatgacgcgaattgcctggccgtgtccgaagcggtcgatggtgccggcgcagggcaggcgctggtgtttggcgtcatcatcgggacaggatcgggcgcgggcgtggcgataaacggcgcgtcgcgcattggcggcaacggcaatgcaggcgagtggggccataatcctctgccgtggatggatgaagatgaactgcgttaccgcgctgaagtgccttgctattgcggacagcagggttgcattgaaacctttgtttccggtaccggttttgccatcgactatcagcgtttaagcggtgtggcgcgcaaaggcgcagagattattaccctgctggaacaggaggaccctgtggcagcactggcgatgagccgctatgaaatacggctggcaaaatccctggctcaggttgttaacctgattgatccggacgtgatcgtgctgggcggcggcatgagcaacgtggaccgtctttaccagacggtgccagcgctgatgaaaaaatgggttttcggcggtgagtgtgaaaccccggtgctgaaagcgatgcacggggattcaagtggcgtgcgcggggctgcctggctgtggccggagtaaatgcatcaggcaagcggtgaccttgtgcaactgactgtgggatgcccagggtcactctctgctggcttagcgagccggggcgaaagcaaacacgatttgctgcggtgcgccctgcgggggtaaaggcatatcgcgtgcgctactgacgctctgccaggctttcagacacagcgactcgtttccttccgtgcgcatcacgttatagcgtccgtccgggcgacgctgtgccgtcaccaggcagcgctggcccgcatattttggcgcatcgtgaaaattgcgcatgaccaacgcattgatctgatgaatataacggttcacgtcctggcactgtgcctgagacagatcggccgtgcagcgcgcttctttcgcctcaggatgatgactgcatcctgctaacagcagcatcgtggccgcaataaatcctgtacatctcaacatgcattacctcttacagaccgggcaattccagcttgctgtaacccagtccattcattttacgtactttaatttgcacgggaatacgctctttcatcgcctcaacatggctgatgacgccaatggtttttccactggcgttgagtgcatccagtgcatccagcgcggtatccagcgtttccgcatccagcgtaccgaagccctcatcaagaaataacgattcgatacgcgttttatggctaaccagatcggatagcgcgagtgccagcgccaggctcaccagaaagctttctccacccgacagcgtacgcgtatcccgcgcgctgtccgcctgccaggtatccaccacgtccagctccagcgcatcgatagcacggcgctgtaaaagatagcgcccatgcaggcgatccagctgacgattagccagggctaccaggtgatcaagcgttaatccctgcgcaaagcgtcggaatttatcgccggttgccgagccaatcaactcgttaagcaaggcccactgcgccagttcggtttcatcctgagcaatctgcgccagtaaggtttgttgttgcgtccgcaggctggcatcgctttgtaactgctgctgcaactgcccctgctgactggcgttatccctgagtgacagccgtaagttttccagctgtgcaaccagcgcatcggcggagtcgggcatattatcgggtttcgcctgctggtgggcagccagccgctgttgcaactctgccagacgtgactgttgatggagcagatgctgatcaatctgctgcagtcgctggcgcagttgttgcgcttcctgctcgtccagcagtgcggcccgcaggctcgcctcgtccgggaagtcggccgccgccagtgcggcactgaagcgctgctcagcctcggttaaccgtgtgctcaacgtatgcagctggctttccagtagcgtcagttggccggtaagacgactgacctctgcctgagactgctgcagccgctcacgttgctgcgtcaacagcatctcgtgaccatcgacactttcctgcatttgctgacgggcctgggtaacctcgcgatcgccaaacagcgccgcgcgctgctggcatttttcctggtgctgctgatccagtgaggcgagctgctgctgtagctgagtcaggcgttgctgctcaagcagcaactgttgttgcagggcttctgcctggctttccgcacgtgccaactgaggctgtaagttagcaagcaaccgctcactttcctgccagcgccgccagcgctgttgctgctccgccagccagctttcgcgctgggcactgtcaggcaacgccaggtgatagtctttgaactgctgattcagcgtttcctgaagctgctgagcgctcgcctgggtctgctgttggtgctgctgtaagcgtagcaatgcctgttgctcattctccagctgctgttgggtcaactggatcgtttgctgatgcttctgtaacgcttgctgctgctgcagatgccgctcttttgcctcctgataagcccgttctgcgctttccagcgtctcgacctgtgcgattaatgcctgttcctgatggcgctgggcctgctgccagttggcgagttcttcggcatcgttcagcgtgaaggtaagcgcaagctcactgctcaaggcctgccagcgctgggctaacccatcaagttgctgcgtcagactggcgatttcgtcctgcagagactgctgctgcaccttcaggtgttttatctgctctttttttgccgtgccggtttcactcagtgcctctacctgcttttgcaggtcagcttttcgctgttggttggcactgacttccagagcacggtaggtttcaaccgcaggatgttcgcaggagccacacagagggcagggttgtccggcctccagccgcgcccgatgctcctccaggtcggcaatgtggctttcgagctggcaaattttctccacgtcggtgagctgctgtttttcccgtttccatgtttcccgcagcgtcagtaattctgcctcagcctgcaggctggctttttcaagatcctggcgtcgtttttcatactgaccacgctgttgatgcagcggctgccactgggtagccagtaacgtcagcgtctgacgtgcgtcacgctgctgatttaactgctttaacgcctgacgtattgcttcgggaggatgggctttctgtagcgaagttagcgcttgctcagcgtcagataatgcgtgctgagcctgctgcccggcctgattcaggggagccagttgctgcccgagctgttcgatctgctgttggcatcgatgaatttgctgttgctgttgctgcacctgttgcgctgacgccacctgttcggtttcataccgtgccagctgagcaaagcggtcctgccacagtggcaggttttcgccccacaacgccagctctgcaagctgctgtcggagagtctgctgctgggtcatcgcctgttgcagatcgctcacctggcgtcgctcggcttgcatcgcctgttcgcgctgcgcgcagcctgcctgctgctgatccgtttcatgctgcaactgctggatttgctgtgctaaggcggaaagcgcctgatcgagcgggatcacctgttcggtcaacagggtttcctgttgtcgctgttgctgacgcgcctgctcgcgggccgtttccatttcctgatagcgctgctgcaactgctgctgctcatgggccgtggccagcatctgctgattgacctgctgctgacgctgttgcacctcatgacgttcagcctgcaggctgtcgcgctgctgcagcgcaccgcgcagtttttctgccggttcacttcgggccaggcgctggcgatcggcttctgccgcctgacttgccgtttctgctgcctgacgggcggcattcacctgctcactgtccgcgctaagctgctgtgccagctgcagccagtgctgctggcgctgagcggtgtcaagctggcggctgagttgctgctcggcttccgtcagtgcagcttgctgctgttgcagcccggttcgggtcgcctcatcaagcagtgctatgccgcccgcccggctgcgcagcaactccagcgcatttttcgcttctttatggcgctcgaacgcggccatagaaaccagaccgtaaatctccgtgccggtcagctcttccagcaactccgcgcgctcgttggctttggcattgagaaacgcggcgaactggccctgtgacagcatcattgagcgggtaaagcgcgcaaaatccagaccactgagcgtttcggtgagcttgagtttgtcgcccactttatctgcaacaatctggttatccgcacagcgtgccagctcgacgcgcggtgcctgcagtttgccgtctgccgtacctcgtgcgcggttctggctccagaatgcccgccaggcttcacctttaatttcaaattcgacttcagccaggcattctgcgcagtcacgcgtcatcagcggattgtgcccctgagagagcatgcccaggcgcggcgtctggtgatacagcgccagacagatcgcatccagcagggtggttttacccgcgcccgtcgccccggtaatggcaaacagaccattgctggcgaaaggctcggtgcgaaagtcgataaaccattcccctttcagcgcattaaggtttttgaatcgcagcgtgaggatcttcatgggttctcctccagctcggccagcgtctgcctgaacagcgttgtaacctgggcaatctgctcatcgtcaagcgcatcgtttagtgccaggcgtcgggcaaaaacctcttcaacattcagttcgctcagggtttcattgtccgtttgcgtcaggctgtgctgacgctgttcacgactgcgccgtaacagcagcacttccaccggtaaatctgcggtcagggcttccacctggcgctgcaggtcacttaagtactcctgagtcgtgacttcaatatccagccagaccggtttttcgccgctcggatgagaaaagtcggctagctgctggctgatttgcgccagtgaacctttgagcatcttcatcggctggaatagcggaatgggcagggcatcgatctccaggcctgcggagccgaacgtcagcagatacacactcttttcgctgcccagctcgtcaaagctcagtggaataggggaaccgctgtagcgaatatggtcgctgttagccacgcgctgagcacgatgaatatgcccaagggcgatgtaatccgctggcggaaatgccgaggcagggaaggcgtccagcgtaccgatgtagatatcacgtaccgaatcacttttgctgacgccaagggccgtaaggtggccggtcgccacgatcggcaggtccatattcagcgcctgcgccgccgcgaaactgcgctgataatgcgcggcaatcgcttccagtagactgatctgtttgtcccgccccgactggccggcctggctgcgcatgatgtcgcgcggacgcaggtaaggaatcgcgcacagtagcgcgccgggttcgccctgacgggtggtcaacatcagcacatcgtcattttcttgcggcgtggcaaccactcgcgtattcagacaggccagcagttcacgcgactcgtttaacgtcgccaccgagtcatgattacctgccagcaccaccagctgacagccgctgggctgtaatgccaccacgaagcggttaaacatttcacgcgcataactgggcggcgtaccggtatcgaataagtcgcccgccacaatcagggcatcaacctggtgctgctcgatctggattaacagccagtcaagaaaggcctggtgttcagcggcacggctcttgttataaaagaactgccccaggtgccagtccgcggtgtggataatgcgcataacactccctgccataacaatttgcccggcaattatactggctctatcactaaagccacaaaacatgtcgtcatgttgtcataaatggttgttgcaagccgacttttatggctaactttttcataaaactgtcacaaaactgacgcataatgacgccgcaaatatcagtgaaagccgtcctacctgcaggagtaataatggctaagcgcattttagttgtggaagatgaagctccaatccgtgagatgttatgttttgttctggaacaaaacgattatcagccgattgaggccgaagattatgacagtgctgtcagcaagctgattgaaccctggcctgatctgatcctgctggactggatgttacccggcggtagcggcatacaatttattaaacatcttaagcgtgaagccatgacgcgcgatattccggttatgatgctgaccgcgcgcggcgaggaagaagatcgggttcgtgggctggaagtcggggctgatgattacatcactaaacccttttcgcctaaagagctgatggcacgcatcaaagcggttatgcgtcgtatttcgccgatggcggttgaagacgtgattgaaatgcagggcctgagcctggacccgtcatcgcaccgcgtgatgtcagaaaccacaccgctggaaatggggccgacagagtacaagctgctgcatttctttatgacccatcctgagcgtgtttacagccgtgagcagctactcaatcacgtctggggcaccaacgtctatgttgaagatcgcaccgttgacgttcatattcgtcgtttacgtaaggcgctggaactgaccggccacgatcgcatggtacaaaccgtacgcggaacaggctatcgtttctctgcccgcttttaaacggagctttaaccgtgctggaacgcctctcctggaagagattattgtccgaactggtgctggcgtgtctgcctgcgctggtgcttggcctgctgtttggctatttgccgtggctcttgttacttagcgtcgtcggcatgttattgtggcatttttacaacctgatgcgcctttctcactggctatggctcgatcgcacgatgacgccgccttcaggccaggctagctgggagccactgttttacgggttgtatcaaatgcaactgcgcaaccggcggcggcggcgcgagttaggtaatctgattaagcgctttcgtagcggcgcggagtcgctgcctgacgccgtaatcctgaccacggaagagggcaccattttctggtgcaacggcctggcacagcagcacctggggctgcgctggccagaggataacgggcaaaatatccttaacctgctgcgttatcctgagttttcacgttaccttcgccagcgggatttcgataagccactgacgctggtgctgaataaccagcaccatatggaattccgtgtcatgccttacagcgaaggccagtggttaatggtggcgcgcgatgttacccagatgcatcagcttgagggagcacggcgtaacttcttcgccaacgtcagccacgaactgcgcacgcctttaacggtgcttcagggctatctggaaatgatgaacgactctgtgatgaatcagcgctcacgggacaaagcgttgcacacgatgtcggagcaaacccgacggatggatagcctggtcaaacagctcctgacgctgtcgcgtattgaggctgccccggtcatcaacatgaaagaaaaggttgatgtgcccgtcatgctaaaactgctgcagcatgaggctgaaaccctgagcggcggacgtcacgctatccattttcataccgatccccatttgaaagtgtttggcaatgatgagcaattacgcagtgccatttccaacctcgtttacaacgcggttaaccatacgccagagggcacgcgcatcgatatcagctggctacgcagcaagcagggcgcggtattcaaggtgtgcgataacggccccggcattgcgtctgagcatatcccacgtctgacagaacgtttttaccgcgtggacaaagcgcgttcacgcgccaccggcggcagcgggcttgggctggccatcgtgaagcatgcgctgagccatcataatgcgcggctggagatcaccagcatcccgcatcaggaaacctgttttacgtttaccctggcaccacggttgattgttactaacgggatgcaggagaatgccgtccattaactgctgacggatcggaacaatgcgcgcgctttttttgctgctcttctctctgttgcctgccttggtgcaggcgcagcctgttatgctttcaggcaatctgagcagcgcaggctcggacacgctcggctacctgatgaccttatggggcgatgactttagccgtcagtcgcccggcgtaaacgtccaggtccaggcatcgggctcgtcaaccgcgcccaccgcgctcaccgccggtagcgtgcagattggggccatgagccggcctatgcaggcggatgagcgccaggcatttgaggcgcgatatggttatcctccgctggcagtaccggttgcgatggacgcgctggtggtggtggtgaatcagcgcaatccgctgcagtctgtcgatccccgccagcttgatgccctgttctctgtcacccgtctctgtggcgcgcagcaggtgcctgagcgctggggcgatctgggcctgcatcaggcagagtggcagcagcgcgctatccagcgttatggccgcaactcggcctccgggacatggggattcttcaaacagcaggcactgtgccagggcgattttcgcaacgacgtggcggaatttcccggatcggcggcggtggttcaggccgtcgccggcgatctgcgcagcattggctatgccagttttggttttcacctgagcggagtaaaattgctgccggtgatgacaaaaagcggtgaggcggttgcacccgatccggattctatacgcagtggccgctatccctgggcgcgcccgctctatctgtatgtgaataaagcccccggtaagcccttgccgccgctgttagccgcttttttacaacaggtgctgtctaaagcgggccagcagcgcgtgagtgaagcgggttatctgccgctgtctgagacgcaaatggccggggcgcgtaaggctctccagtaggctttcctgactgtgcagaacccaaggatcaccaggcatccttgataaagaacgttctccattttagccgcgcgccctgtgcgggctacatcctggctatgctgttcagcgtccatagcatccacagattccacagcgtcagttgcgccgggtaagaatgctgatgcgtaaaaggataaccgcgaaatccgctcttctcgtcgcaacatgaatctttttcatccccagtgaatttttttcgtttgcgcagaagcaggtcacatgacaatctgcattcagacgtttagccatctggaaggctaaaattacattgtgtaactattcccgcccgaaattatctactgatctggcgggtgatcaggagtcattatgcaaagacaaaccgccccgtttcgtgccgatactgttggcagcttccttcgtcccgtcgccattaagcaggctcgtgaaaaatttcatgcgggcgagatcagcgctgacgaactgcgtgatgttgaaaatgaagcgattcgtgacgtggtggcgaagcagcgtgaaaatggccttcaggttgttaccgacggggaatttcgtcgtggctggtggcactttgactttttctacggcctgaaaggcgttgaacactatgaagcggatcagggcattcagttcaacggtgttcagaccaaagcgcacggcgtaaaaattaccggcaagctgggttttgatgggcatccaatgctggcgcatttccgcttcctgcagagcgtagcgggggatgcggtggcaaaaatgaccatccccagcccaagcgtgctgcattttcgcggcggacgtaaagtgatcgacgcaaaggtttaccccgatctggatgtgtactttgacgatctggcgcagacctacaaagaggcgattaaagccttttacgatgcaggctgtcgctatttacaactggacgataccgtctgggcctatctctgttcagaggagcaaaagcgtgagatccgtgagcgcggcgacgatcccgagcagttggcccgcacctatgcacgtgtactgaacaaggcgttagaaggcaaaccggccgacctgaccgtcggtctgcatgtgtgccgtggcaatttccgctcgacctggatttctgaagggggctacgagccggtggctgaaatcctgttcggctctgtcaatgtagatgcgtttttccttgaatatgacaatcaccgttctggcggcttcgaaccgctgcgtttcatcaagcctggccaccagaaggcggtactgggtttaattaccaccaaggtcggtgaactggaagacgccgcgcaggtaaaagcgcgtttacaggaagcgacgcagtacatcagcctcgaccagatttgcctcagcccgcagtgtggatttgcctcaacggaagagggcaacagcctgaccgaagagcaacagtggcagaagattcgtctggtggtggatgtcgccagccaggtgtggtaatcgctgaatctgtgcaacgtggcgcaatacatgcgccacttgtgcacaaaaacccgcatgtatgctgatatttcccatcgcctgtttatttttaaagcacatcatctgatgcactttctgcgaatattgatgtgatcctctgatattggtttaaattgcgaaataagcctctggttttccgatcctgtattgcctttctccgctataaacgttttacttaccgccgttgtcgatttatccctctgtgaacagaaaaaaagcagctcaaatcacctgcgctaaaccagacgctacgcataatgcgctgttattgtctggcaagtcgtcgtattaacgcagcgaggggacaacgcaaacttatctttcatcgcaacatcagtgacaggccgtatgacacatcgtttaaccgttaaagacattctcgcgctgggcttcatgacgtttgccctgtttgttggcgcgggtaacatcatctttcctcccatggtcggtattcagtcaggcgaacatgtctgggtggccgctgtgggctttctgcttaccgccgtgggcttacctgttatcaccgtcatcgcccttgcgcgcgtcggcggcggtattgatgcgctgagcacgcccattggcaaagttgctggcgtggtgctggcaacggtctgctaccttgcggtcgggccgctttttgccacgccgcgcaccgccacggtctcatttgaggtgggcattgcacctatcactggcgatggcccgctgccgctgtttatctacagcctgatttactttgcgctggtaatggtgatttccctctatccgggtaaattgctggatacggtcggccattttctggccccgctgaaaattgcagccctgacgctgctgggcgtcgcggctttgctgtggccggcgggcggaacgattcccgcgacggcggactatcagcgcgccgcattttccagtggttttgtgaatggctatctcaccatggatacgctgggcgcgatggtcttcggcattgtcatcgtcaacgcggcacgttcgcgcggcattgataacgcagcgctgttaacccgctacacggttttagctggggtgatcgctggcgtcggtttgacgctggtctatctcagcctgtttaagctgggcgcgggcagcggtgcgttagtggatcagaatgccaacggtgcggcgattctgcatgcttacgtccagcagaccttcggtgacatgggcagcttcttccttgccgcactgattttcattgcctgtatggtgacggctgtgggcctgacctgtgcctgcgcagagttttttgcgcaatatctgcccttgtcttacaaaacgctggtctttgtactgggcctgttctcgatggtggtgtctaacctggggctgagccatctgattcagatttccattccggtgctgacggccatttatccgccgtgtatcgtgctggtcgtactgagttttacgctgaactggtggaacaaaagcagtcgtatcatcgcaccgactatgctggtcagcctgctatttggtatccttgacgccatcaaaaccaccgggtttaaagaggcgttacccgcatttagccagcatctgccgctagccgaccagggccttgcctggttgccgccatcgctggtgatgttgctggctgtggcgctggtcgatcggttgaaagggccagaacaggtgtcggttcactcgtaacggctaagattgattcttctttaaccacgggcttgcccgtggttttttcatttcacaggtacaggttgttatgcaagaaaccaacaagctcaaacgcggactgagcacgcgccacatccgttttatggcgctgggatcggcgattggcaccgggctgttttacggctcggcggacgccatcaagatggcaggaccgagcgtactgcttgcctatatcattggtggcgcggtggcgtacatcatcatgcgcgcgctgggtgagatgtcggtcaacaacccgcaggccagctcgttttcccgctatgcgcaggattatcttggtccgctggcgggctacatcaccggctggacctactgctttgaaattctgatcgtggctatcgcggacgtaacggcgttcggtatctatatgggcgtctggtttccggaggtcccgcactggatctgggtgctcagcgtggtgctgatcatcggcgcggtcaatttaatgagcgtgaaggtgtttggtgaagtggagttttggttctccttcttcaaggtcgccaccatcgttgtgatgatcctggccgggtttggcatgatcatctgggggataggcaacggtggccagcccaccggcattcataacctgtggaccaatggcggcttttttgcgcacggtctcgtgggaatgttgctgtcgctgcagatggtgatgtttgcctacggtggcattgaaatcatcggtatcacggcgggtgaagccaacgatccggccacctctatcccgcgcgctatcaactccgtcccgatgcgtattctggttttttatgtgggtacgctgtttgtcattatgtcgatttatccctggaatcaggtgggcaccaacggcagcccgtttgttctgacattccagcatatggggattgcggcggcagcgtctatcctgaactttgtggtgctgacggcctcgctgtcggcgatcaacagcgatgtgtttggcgtcggacgtatgctgcatggcatggcacagcagggccatgcacccaaaatgtttatgaaggtctcttcgcgcggtattccctgggtgacggtggtggtgatgatgtttgccatgctgattgcggtgtatctcaactacctgatgccagaaaaagtcttcctggttatcgcctcgctggcgacttttgccaccgtctgggtttggatcatgattctgctgtcacagatggcgtttcgacgcaagatcggcaaagccgccgcccgtgggttaacctttgcgttgcctggcggaagctggacagcaggctttggcgtggcatttctgtgttttattattggcctgatcggctacttcccggacacccgcatttcactgtatgtcgggatggtatggattgtggtactgctgctgggctataagctggtgcgtaaataacgcggttgatttgtcccagcccggatatcaacgggttggggcaaaacaggattggcggtaaggcaaaataaaatcggcgaaatgactcgccgaaaacagatatggcaaatgaaacaaatagagggatgattgacgaaatcatgctaatgcaaaacgcgccgccattaaataagttgccgtaaaataagacaaaggccagcgctacgcccggcgaaaccgtccgggccgcgtacgttatccgtccgaagacggcaatatcatgctgaccggaacgcgcgcgctgttatctgtctgcttacccaactgcgtaacggccgcctgtaacgggcaaagtgttccgaccgctgtgattttgcatccgggttgccgccattcctgacgcaacaggggatggctgtcgctcaccggttgcaactgacgcaggccatccagactttgtgcctgaaaatagaggcgcaggtagcgctgatgcgtatttcggtcccgccagcgttccagcaccaggctgcttcccggtggaatattaccgcgcgtatagccgggcagttgccagtcaaatcccattaagcggcgcaccatcgcaatgttggtgtcatgtgccaccagaagcagccagcgcacgtccggatcattaccttcaatagcctcaagcatctgtgacagcagcagggaaccgtgacgttgtgccatgtagagcacatcattgctgagattataattggctgtcagcagcgggagcagggcggtgatctgttgggcggacgtaatgtgcccccaggccagcttcgcgaacggtaagttttcactgtaacccagccgcagcgtctcgaccatggcggccatggcgcttaagccttcaacataaacgctgccgctttttgtctgtttgaactgccaggggcgatcgaaaaacggacaatcgctgctggccggacataccgactgtttaagcagcgcaatcgcaggctgaagctgctgctggcgttgggctaaatcgcccgccacgcgctgttttgccgccagttcgcgctgcggatcggtctgggcaaaggggagcttctccgtctgaaacagcggatcgacatcgcccttaacggtatgaaccgccacaccacagccgggaaaggcaccgtccaccagcgcctcggcggtagcgcgcgttcgctgcagcgggctggcgcgcacgtagagcgctgtcgcatcagggcaacccgcgttgagtaaacccaactggcgatagtgctccccttcccagcgtgctttattcaccaccgcgctgtagccatggcccgtcagttcaccgtctgccgtgatccagacgtaccatggctgctggcttgccgcttcaatctctttacgattaccgggcgtcggcggacgtaccccgtgtcggctcagttctaccactttctcaagttggtattccggggccgcgtgcagcggccccgccaacaaccacaacgcgcagagcgcaatcaagcgccggggaacatgggcaggcatcatcaatcctcaatttcatgcgtcgcaagcagcgctttaatttgcggatagattaccgcattcgccagcaaaacaggattgccctttttcagaccgtcgttgcgcagataatcgttggtcaccccgccggcctcacgcattaacacgatgccgggcaggctgtcccagggatgcatatgtgcttcataatagccaatcagacggcctgcggcggcccaggcactggttaaagccccggagccgatgcgaataaacatcccaccttccctgagcagggcatcgatgagctgcgtcactttttcaccgggaacacggctggagttactgatccccagcaggccttcattgaggtgccgggctttatgcacttcgagccgggtctcgttgagccaggcgccattccctttgcgggcgtgaaacagctcgtgatgattgggatcgcaaatcacgccaacgaccggttcgccatcgcacacaatcgccagcgagacgcaccagttatgcaggccgttaacaaagcaggctgtgccatcaatgggatcgatcacccatacaatacgggcaccttgcgtgtcaccgccgctctcctcgcctaaaacggcatcatctggataacgttctgagatcaatgatttaattaattcttcaacgttgcggtcagcttcactgaccacatcctgaagatcccttttatgttccaccaccagtttttgacgctgttgataccatgaccaggcgcggcttgccgccgcacgggcgatttcgcaggcgtaatgatagcgcgcgtcaatttcagaatgcgaagcggatgacatgtttccctcttatgattttaaaccatatcggataaaggaagcgcctgaacaggcggtctgacagtgagagcaacgtaaatcatagttaagcaaggcttattaagccgcagaccggaagtaatggcaatacggctgtatgactgactgcgcgctttttcagcgttacaggttgatggtgcaatgaaaagcgctcacaaacccgatgtaaaaaggaggggaggttatagctgctgctcaacagccagggtcatcaggcgcggatagaactggaaaaagcaggcttcaaacgcagcataatgcgccctaaagtcgtgataagagtcgcgcagagcggccagttttggccgacggctcgccatcccgttcagcacccgttcaagacgctgtggatcagcgtaatgctcgaaccagcgttcacgccacatcaccgcattgagggctttaaattcgtcaggcgtggccgccagttgcggaacaatttcactttcggctttggcggtaaattgttgcaacgtgtgtgcctgatgaaagcgatcccagtggcgtgccaaaaaatggtcccagataacatccagggtaatgggtgcgacacggtaggtttcagcccgaaaccgctgacgcgcctctcgcacttccggcaaggcatcggtcataacatccaggcgacgatgcatcagaatgccgtcggccaccggtttgggccagtgttgatgcggcgcaccgcgaacgaaatccgccatcagattgccgagtagcgagctgtctgcaagatgggctaagtgaagatgagcaagaaaattcatgcgctattataagcgcaactcgctttgcgcagccagttgttcagaattgagcgattttccgctaaactgtgccgcctgtttttctgagtaagaagtctgtcatgcgtgtcgccgattttgcttttgaattgcccgaatcccttatcgcccattatccccaggcgcagcgtagcggttgccgcttactgtcgctggacgggtcaagtggtgcactgagccatggcgtgtttaccgatgtgctggacaagctgcaacctggcgatctgctggtgtttaacaacacgcgcgtgatcccggcccgggtgtttggtcgcaaggcaagcggcggtaaaatcgaaatgctggttgagcgcatgcttgatgacaagcgcgtgctggcacacgtaagggcgtccaaagcgccaaagcctggcgcagcgttgctgctgggcgacgatgaaagcgttaacgccacgatggtcgcgcgccacgatgccctgtttgagattgcgtttgaggacgatcgggccgttctggacatcctcaacagtgtaggccatatgccgctgccgccgtatattgatcgtcccgatgaagaggcggatcgcgagctttaccagacggtatacagcgcccgtccgggggccgtcgcggccccgaccgccggtctgcactttgatgaacccctgattcaggcgctgaaagacaaaggcgttgaaatggcctttgttaccctgcacgtcggggcagggacgttccagccggtgcgcgtagaaacgattgaagaacaccatatgcacgccgaatatgcggaagttccgcaggaggttgtggatgcggtactggcctgtaaagcccgtggcaataaagtcgtcgcggtggggacaacctcagtacgctcgctggaaagtgcagccaaagccagccaggatgcgctgattgcgccgttcttcgatgacacccaaatctttatctatccgggctatgagtatcaggtgattgatgcgttgatcaccaatttccatctgcccgaatcgacgttgatcatgctggtatcggcctttgccggttatcagcacacgatggctgcttatcgtgcggcggtggcggaagaataccgtttcttcagctacggcgacgcgatgtttatcagcaaaaacccacaggctccgcgggaaaaagtgggtgcctgatctgttttaatttaaacattggactgtttctccaatggaggtcttgtgaaatttgaacttgataccacagacggtcgcgcgcgtcgcggtcgtctgattttcgatcgtggcgtggtggaaaccccggcgtttatgcccgtgggtacctatggcaccgtgaagggcatgacgccggaagaagtgcaggaaaccggcgcgcaaattattctgggcaacacttttcacctctggctgcgtcccggccaggaaatcatgaagctgcacggcgatttgcatgattttatgcagtggaaaggccccattctgaccgattctggcggcttccaggtgtttagcctgggcgacattcgtaagatcaccgaagccggtgttcatttccgcaatccgatcaacggcgacgcgattttcctcgatccggaaaaatcgatggagatccagtacgacctgggatcggacatcgtgatgatcttcgatgagtgcacgccgtacccggcagactgggattatgccaagcgctctatggagatgtctctgcgctgggcgcaacgcagtcgtgaccgttttgacagcctggggaacaaaaatgcgctgtttggcattattcagggctcggtttacgaagatttacgtgatgtctctgtgaaaggtctggtagagattggctttgatgggtacgctgtgggcggcctggcggtcggtgagcctaaagaggatatgcaccgtatccttgagcatgtttgcccgcagattcccgaggacaaaccccgttacctgatgggcgtcggtaaacctgaagatctggttgaaggcgtgcgtcgcggcgtggatatgtttgactgcgtcatgccaacgcgtaatgcgcgtaatggccacttatttgtgaccgatggcgtggtaaaaattcgcaatgcgaagcataaagacgatgtttcgccgctggatgcggagtgtgattgttacacctgtcgcaattacagccgtgcgtacttgcatcatcttgatcgctgtaacgaaatactgggcgcacgtctgaacacgattcataacctgcgctattaccagcgtttgatggcgggtttacgccaggctatcgaagagggtaaattagagcgctttgttagcgagttctaccaacggacgggcaaagcggttccgcctttaacgtctgataattcatcaatgagggaaatttaatgagctttttcatttctgacgctgtggctgcagcaggcgcaccgtctcagggaagtccgtattctctggtgatcatgctggtcgtctttggcctgatcttttacttcatgatcctgcgcccgcagcagaagcgtgcaaaagagcacaagaagctgatggattctatctccaagggtgatgaagtcctgacgaacggtggcctggtgggtcgcgtaacaaaagtggcagaaaccggctacattgctattgcgctgaacgacactactgaagtggttatcaaacgtgatttcgtggctgccgtcctgccgaaaggttctatgaaggcgctgtaatttttacttccctaagggaactgccgtgttaaatcgttatcctttgtggaagtacataatgctggtcgtggtgcttgtcattggcctggtgtatgcacttcccaacctttatggtgaggatccggctgttcaggtcactggcgcgcgcggaagcgccgccagtgaccaaacgttggatcaaattcagaacgtattaaaacaagacaatattcaaactaagtctgttgccctggaaaatggcgcgatcactgcgcgttttgccaatacggatgtgcaactgcgcgcccgtgaagcgatcatgaaagcgctgggcgaaaactatgtggttgccctgaacctcgcaccggcaacgccgcgctggctggctctgctggcggcacagccaatgaagcttggcctcgatctgcgtggtggtgtgcacttcctgatggaagtggatatggatactgccctgagcaaactgcaagagcagaatgctgacagcctgcgcagcgacctgcgcgaaaaaaatattccctataccaacgtcaacaagattgctaactacggcgtggaaattcgtttccgtgatgctgccagccgcgatgctgcggtgaagtggttgtcatcccgtcatcaggacctggtcatcaacagcagcggcgatgattcgctgcgtgccaccatgaccgatgcgcgtctcagcgaagcacgtgaatacgctgttcaacagaacatcactattctgcgtaaccgtgtcaaccagctgggcgttgctgaacccctggtacagcgtcagggttctgaccgcatcgtggttgaactgccaggtattcaggacaccgcacgtgccaaagagattttgggcgcgacagcgacgctggaattccgtctggttaacaccagcgtggacccaagcgctgccgccagtggccgcgtaccgggcgactcggaagtgaaagacacgcgcgacggacgccctgtggtgctctataagcgtgtcatcctgacgggtgaccatattaccgactccacatccagcatggatgagtacaaccagcctcaggtgaacatttcactggacggcgcgggcggtaatattatgtctaacttcaccaaggacaacatcggtaagccgatggcgaccctgtttgtggagtacaaagacagcggtaagaaagatgctaacggtcgagccattctggtgaaacaggaagaggtgattaacgtcgccaatatccagtcgcgccttggcaacagcttccgtattaccggtatcggcaacccgaacgaagcacgtcagctgtcgctgctgctgcgcgccggtgcgctgattgcgcctatccagattgtggaagagcgtaccatcggtccaaccatgggtcagcagaacattactcagggtctggaagcctgcctgtggggcctggtcgcctctatcctgtttatggtgctgtactacaagaaagtgggcctgattgccaccagcgcgctgctggcaaacctggtgctgattgtcggtattatgtccctgttaccgggtgcgacgctgacgatgccaggcattgccggtatcgtcctaacgctggcggtggcagtcgatgctaacgtactgattaatgaacgtattaaagaagaactgcgcaacgggcgttccgtacagcaggcaatccatgagggctataaaggcgccttctccagtattgtcgatgctaacgtaaccaccctgatcaaagtggtgattctgtatgcggtgggtacggggtccattaagggctttgcgattacaacggctattggtatcgcaacctcaatgttcacatcgattgtcggtacccgcgccatcattaacctgatgtacggtggcaagcgcgtcaaaaagctgtctatctgaggagtgcgttgtggcacaggaatataacattgagcagttaaaccacggccgtaaagtcgtcgactttatgcgctgggatacgctggcatttattatttcgggattgttaatcatcatctcgattgccattgttggcgtacgtggctttaactggggtctcgatttcaccggcggtacggtgattgagatcaacctggagaaacctgccgatctcgacacaattcgtggcgagctggttaaggccggtttccaggagccgctgatccagaactttggcagcagccgtgacgtgatggtgcgtatgccaccggttactggccctgcaggcaccgagttaggtaataaagtggtgacggtaattaaccagaccacgcagcaaaatgcgacggtaaaacgtatcgagtttgttggacccagcgtaggcagcgatctggcgcaggccggtgcgttagctttgatgtcggcactgattgcgattctgatctatatcggtattcgctttgagtggcgtctggcgctgggtacggtgctggcgctggcacatgacgtgatcatcacctgtggcctgctgtcgctgttccgggtggagatcgacctcaccattgtggcctcgctgatgtcggttatcggttattcgcttaacgataaaatcgtggtgtcggaccgtattcgtgagaatttccgcaagatccgccgcgggtcctcttacgatattaccaacgtgtccctgacccagaccttgagccgtaccttgatcacctcgctgacgacgttggcgatgatcctgattctgttcatctttggtggtgcgctgctgaaaggcttctcgctgaccatgctgatcggtgtcactattggtacgatttcgtcgatttacgtctcttcagcgctggcgctgaagctgggcatgaaacgcgaacacatgctggtgcagaaagtcgagaaagagggcgcagaccagccttccatcctgccgtaatctgtgcatcatggaaaagccgccagcgcaatctggcggcttttttttgtcgttaagacctgggcgcagccgttttggccagcacctgatgaacccggacatagccgagctgctctggcgtaataccgctcaaacgtaacggaaccgtgaccgaactgcgcggcgtcagcgcggtcggcaccgtgatggtctgtgtcaggctgtcggcttcaagcggcttgcccgttgcgggatcaagctggccccataccacggtggcctccagcgcaggcagcggctgattatcgcgtgtctgcagagtcaggttagcgcgtgatccgccagcttcagcctcaacctgtgataacgataagcgcaacgtaccggcctgggtttgcaattcaacaggcgtattggcctgcggtaatagccatgcgccctgctgtgagtgcgcgttaagctgtccctgaatctccaccgcgcctgcctggctggtgagctgctgcatctgctgattgagttggctgacttcctgatggagctgtttcacctgcggctgttgcgttgtgctgcaaccactcaacagaaccagcgacagggccgcaggtgcccaaaccgtcctgatcatcatttatccttttccgttatagagaaatacctaaaaaccgccccggcacaggttgtccgtggggctgcaatgatttatcgaaatcaatggcgttcacgtatccggtcgtgccttttaacctgaccgttgccgatatcacgttatcttctacgtgagcgatggcgtcaagactgcctttagcgaccaggcgtttctttttccgttaacggaatagtctgacgacctgaggttcacccttgacgtccccatccagattctttctgtcgggtaatccggccgtgtaaacccactgccgcgttgcgtccgggttatcgccaataagcaagccgcaccggcgtttgtgccagcttctttgcaaagataacgcctgctgccggggataacatttagcgcatgacgcggtaagcggcctgctttttgtcttcgtgagcgttttgctccctcaggctgtaaggacgacagggtaaagcacgggaatcgattttgttgacctgcagttcgcgctacactgtatgacctatttatctcgtgtcaggaaacgtcatgcattgcccattctgctccgctgtagacactaaagtgattgattctcgtctggttagtgagggttcatcagtgcggcgccgtcgtcaatgtctggtgtgccatgagcgttttacgacgtttgaagtggctgagctggtgatgccgcgcgtggtgaaaagcaacgatgtgcgtgaacctttcaatgaagacaaactcgccagcggcatgatgaaagcgctggaaaagcgtccggtcagtgcggatgcggtagagagtgcggtaagccatattaaaacccagttgcgcgcgaccggtgaacgtgaaatccccagcaagctgattgggaacctggtcatggatgaactgaaaaagctcgataaggtggcctatattcgctttgcttccgtttatcgcagcttcgaagatgtgcgtgattttggcgaagagattgccagattacaggattaaatcatgactgatgaacacgctatggcgcgcgcgctggaactggcgcggcgcggccgctttacgaccacgcccaatccgaatgtcggctgcgtgattgtacgcgacggccagattgttggagaaggctggcaccagcgcgccggtgaaccccatgcagaagtgcatgcgctacgtatggcgggtgaccgcgcccggggggcgaccgcctatgtgacgctggaaccctgcagccatcacggccgcacgccgccctgttgcgacgcgcttattgccgctggcgtaacgcgggtagttgctgccatgcaggaccccaatccgcaggtggctgggcggggattgcatcgtctgcgccaggcgggcattgaggtcagccacggactgatgatgcaggaagcggaagccctgaatcgcggttttctgaaacgcatgcgcaccggctttccctggatacagttaaaactgggcgcatcgctggacggccgcacagcaatggcaaacggtgaaagccagtggatcacctcggcggctgcccggcgggatgtacagcggttgcgcgcccagagctctgccatcctcagcacgagcgcaacggttctggcggatgatccctcgttaacggtgcgctggtcagaactggacagcgacagccagcgcctggtggatgaagcacagctgcgtcagccggtcagagtgatcgtcgatagccagaatcgcgtaacgcctcagcacaaacttattgaacaattgggcgaaacctggctgatgcgtcagcaggccgacgatctgcgctggcccgaaacggtcacgcaaattcctgttccgctgcgcgacagccagctggatttagtggccctgatgatggtgctgggccagcggcaaattaacagcgtctgggtagaagcgggtgccacgctggcgggtgcgctacttcaggcaggcctggttgatgagctgattttatatgtcgccccgaaattactcggcaatgacgcgcgtggtttgtgccagctggcgggcctgacagcgttggccgatgcgccggtctttgccttcagcgatatccgtcaggtcggcagcgatgtgcgcctgaccctgacaccgcaataacagaggcggaaaagcgagagcacgccgccaaagagtatgttagaatccgcccccctgcgcggggccaaacaaacccctgaaaggatatgtatgaaagttatcgaagctgccgttgcaacgcctgaggcaaaccttgccatcgttatcgcgcgttttaacaacttcatcaatgacagcctgttagacggcgcagtcgatgccctgaagcgcatcggccaggtcagcgatgacaatatcactgttgtctgggtgccaggtgcttatgaactgccgctggcagcgcgtgcgctggcaaaaaccggcaaatacgatgccgttattgctctgggtaccgtgattcgtggtggcactgcgcacttcgaatatgtcgcaggcgaagccagctccggtattgccagcgttgccatggactgtgatattcctgtggcatttggcgtactgacgaccgaaaatatcgagcaggccattgagcgtgctggaaccaaagcgggtaataaaggtgccgaagcggccctgaccgcgcttgaaatgatcaacgtattgaaagccattaaagcctgatttttgtaaggggaattttgtgaaacctgctgctcgtcgtcgcgcccgtgagtgcgctgtccaggcgctttactcctggcagttgtccaacaacgacattgccgatgtggaataccagtttctggcggaacaagacgtcaaagacgtcgacattacctatttccgcgaactgctgaccggtgtggcgaccaacagcgcgtacctggatggcttaatgaagccctatctgtcgcgtcagctggaagagctggggcaggtggaaaaagccattctgcgtatttcgctgtatgaattgagcaagcgttctgatgtgccctacaaagtggccatcaacgaaggtatcgaactggcgaaagtatttggtgccgaagacagccataaatttgtcaacggcgtactggataaagctggtccacagattagaccccaacgcaaataatcaataaggccggcttgccggcctttttcattaatggttaagcggaacgcaattatgtcatgtggtgaatttgaactcatcgcacgctacttcaaccgcagaacgcggagccgccgtgatgtcgaactcggcatcggcgacgattgcgcgttgcttagcgtgcccgaaaaacagacgctggcggtcagcaccgatacgctggtttcaggcgtccacttcctgccttctatccatcctgccgatttagcctataaatctctggcggttaacctgagcgatttggctgcaatgggggccgatcctgcctggctgacgctggcgatgaccttgcctgaggtcaatgaagcctggttaagcagcttcagcgaaagcctgttcgacctgctggaatattacgacatgcaactggtcggtggtgacacgacgcgcgggccgctcagcctgacgctgggaattcatggtttgatcccgcacggcaaagcattgaaacgatcgggcgctaaaccgggcgactggatctacgtgaccggcacgctgggtgacagtgccgccggactggcgttattacaacatcactgtcgcattgacgatccggcgatacatgaagccctgatcaagcgccatttgcgcccgatgccgcgcattctgcaggggcagtcgttgcgttccctggcgtcttcggccattgatttatcggacgggttgatctccgatttgggtcatgtgctgaaagccagcggctgtggtgccaggatcaatcttgatgcgctgccgctgtcttctgcactgcgtgaaaactttgatgccgtacaggtactgcgctgggcgttgagcggcggagaggactacgaactgtgctttagcgtaccggaagtcaatcgcggcgcgctggacgtagcactgggtcatcttggcgtgccttacacctgtatcggccagatggcaccggagtcagaaggactgtccctgctggacaacggcaaaccgacagaattccgccataaaggattcgaccattttgaccacagataaaaccctcgccaaaagtcgcctgcgcctgcgcaatccctggcatttactggcgaccggcttcggcagcggactcagcccgtttatgccgggtacggtgggatcgctggctgccatcccgttttggtggctcatgacctttctccctcatgacctgtactcgctggtcgtgttattgggcattagcgtgggcgtttacctctgccatcgcaccgccaaagatatgggcgtgcatgaccacggtagcattgtctgggatgagtttatcgggatgtggattaccctgatggcgattccggttaacagctggcaatgggtggtcagcggctttgtcctgttccgggtgctggatatctggaagccctggccgattcgctggtttgaccgcaacgtgcacggcggtatgggcatcatggtggatgatattatcgcaggtattatcgcggcggcgatgctgtacggtacaggcgtttatctggcgggataaccttgccgggtgacgcaaaacaacatcgtcttaacctgcatattgctttacagcacaacgaccgttcccgtgcaatcgcgggaacggtcgtcactatcaaatcagtgctcagattagcgcatattcaacagacaatgccgctgcccggatagcgcgcctccctgaaagttccttactgatagcccgttgccggatgcggttgataagcctcttccagtttggcgatatcatctggcgtcagctcgacgtttaccgcattgaccagatcggcaaactgctctgcacgggaggcaccgataatcggcgcggtgacggcaggcttgctaagcaaccaggccagagccacctgtgcacgcgtcgcgcctttatctgccgcaacctgcgccaggcgctcggctattacggcgtcgttttcctcggttgaggcatagagcgatttgatgacctcatccgacacggagcgtgcggtcgtttctccccacggacgggtaagcttgccgcgcgccagcggactccagggcagaaccgcaatgttttcccgctggcacaaggggtgcatttcacgctcttcttcacgctgaatcagattgtactgatcctgcatggtgacaaagcgcgcccagccctcctggtcctgcaatgccagggcctgagcaaactggttggtatgcattgaggaggcaccgatataacgcgcctttccggatttcaccacctcgttaagcgcatccagcgtctcttccagcggcgtgtcatagtcccagcggtgaatttgcagcagatcgacatagtccatgccgagccgttgcaggctgtcgtcaatggattgcaggatattttgacgggataagccctgcgacagattgctcatgggaaagaaaactttggtggcgaccaccacctcatcacgccgggcgaaatcgtgaagcgcccggcctaaaatttcctcgctactgccatccgaatagctgttcgcagtatcgaaaaaattgatcccggcgtcgagtgcctggcggatgagcggacggctgctctcttcaggcagtgtccaggcgtgcttgccacgatcgggttcgccgaaggtcatacagcccaggcaaagccgtgaaacccttaagtcggtattcgctaattgaatggttttcatgatgactcctgctatgtctttcccaggggatcaagcatagcaggaatgccgctctccgcagagagcggggcagggaactattgcgccagccagcgactgatttgctgttgaataccgtcaacgtccagttggtagacgtgacgcatctcttcctgcgtgccgggtggaataaactcatcaggcaggccgatattcagcaccggcacacccaggcgcttagccatgacatactcattcacgccgctacctgcgccgcctttaatcgcgccttcttccagcgtaatcaaggattcgtgacgggccgccagctcagtgatcagtgccgtatccagcggtttcacaaagcgcatgtcaaccagcgtggcattgagtgcgtccgccacctggctcgcttctggcaacagcgtaccaaagttgaggatagccagtttttcgccctgacgttttaccacgcctttacccagcggcaggctttgcagcggcgttaatgccgcgccggtgccggtgccgcgcggatagcgaaccgcagccgggccatcctgatagtgatagccggtatacagcatctggcgacattcgtcctcgtcgctcggcgtcataatcaccatgtccggaacgcagcgcaggtaggcgagatcgaacgcgccctggtgcgtttgaccgtcagcacccacgatgccgccacgatcgatagcaaacaacaccggcagcttctgaatcgccacatcgtgaatcacctgatcgtaggcgcgctgcaggaaggtggaatagatagccaccaccggtttatagccgccaatggccaggcccgctgcaaaggttaccgcatgctgttccgcaatagcgacatcaaaatattgattgggatacttgcgagagaaacccaccatgccggaaccttcgcgcatggctggcgtaatggccatcagtttcgcatcgtcagcggccatctcgcacagccagttaccgaaaattttggaatagctcggcaaaccttcggcgctttttggcagctcgccgctggcaacgtcaaattttggcaccgcatgccaggcgatagggtcctgctccgccggagcataacctttgccctttttggtcataatatgcaggaactgcgggcctttcaggctgcgcatgttgctcagcgtattcaccagcgtcaggacatcatgtccgtcaaccgggccgatatagttaaatcccagctcttcgaacagcgtaccgggcacgaccatgcctttcaggtgctcttcggtgcgccggactaactctttgatcggtggcaggccggtcaggacgcgcttaccgccctcgcgcaaacgggcataggttttgccggataaaatctgcgccagtcggttattcagggcacccacgttttcggaaatcgacatttcattgtcattcagaatgacgagcatatcggacttgatatcgcccgcatggttcatggcttcaaacgccatgccggcagtgattgcgccatcaccgataacgcaggcggtgcggcggcctttgccttcacgttcggcagccgcagccatccccagtccggcactgatggaggtggaggagtggcccacgctcagcacgtcgtattcactctcaccgcgccagggaaacggatgcacgccgttcttttggcgaatagagccaatgcgatcgcgacgacccgttaaaattttgtgcggataagcctgatgaccgacgtcccagaccaggtgatcgaacggtgtgttataaacgtaatgcagcgccaccgtcagctcgaccacgcccaggcccgacgcaaaatggccgcttgagcggctcacgctgtctaataaatactggcgcagctcgttgcaaagcgcaggcaatttctctttaggcagggctcgcagcgcctgaaccgtttctgcctgcgccagtgtcgggtattttgtagtatcaaaactcatcagtgactcatcatggaagttatttatcgcgttcaattacgaagctcgccagcgccttcaaggccttagtgttataggattttgcagagagcatatgcaaagcatcgacggcttcctgatacaaatccagtgccttagtgcgggcattatccagacccatcagtgaaggataggtgctttttccaagatcttgatcggcaccttgacgttttccgatgacagctgtgtcgcccgtcacatccaggatgtcatcctgcacctgaaaagccaggccaatcgcatcggcatagcggtcaagatgcgggagcgcttcacgacctttttccccggcggcaaaggcgccgagccgaacggctgcgcgaattaacgccccggttttatgacgatgaatctgttcaagttgggtcaggcccactgactgaccttcagcggccagatctaacgcctgtccaccgcacatgccggctacgccgctggcttttgccagctcggacagcatggccagtcggtattccgcgcttacgcccggcatcggctggtcggcaagaatcgaaaaggccagcgtttgcagcgcatccccggcaaggatagccgtgtcttcaccatatttgatatggcaagtcggttgaccacgacgcagggcgtcatcgtccattgccggaagatcgtcatgaatcagtgaataggcatgaatacactcaactgccgcagcgggcgcatccaggctggcgttgtcggcgtgaagcatttcgccggtggcgtagaccagaaacgggcgcaggcgttttccgcctaataatgccccatactgcatggcattcaccagaggagaactctgaaaaggcagagcatctaataagcccgtcaacgcgcggttcacctgccggtgataggcgtcgagcagttcaggaaaatccattagctgttttccggcgtaaaggaggagaggtcggcgtctttatcatcgctgagtaaaatacgaacgcgctgctcagcctgttgcagcgtctgttggccgttgcgtgctaactgcacgccgcgctcaaattcattgagtgcctcttccaacggcagttcaccactttccagacggctgacaatctgttccagctgctgcaatgacgtttcaaagctggctggctgttcggcttttttcggcatagttaggatcgactcacggttgggacgttatcttgcaatcggtcatggtagctgacagagaatgattagcaaaataatcaatgcgcatgctgttgcagaagcagtcaccgggtaaaggtgatatactctcgcgcctcggatgcggatgcgcctggcaccccgcaattttatgatcttaccagctaagtgcagcctgttttagcacttatttgcccaacgaagctgtatcgccatgaagtttatcatcaagttatttcccgaaatcaccatcaagagtcagtcggtgcgcctgcgctttattaagattcttgccagcaatatccgtaacgtgctcaaaacggtcagcgatgagatcgcggtcgtgcgtcactgggatcatattgaagtgcgctgtaaagatgaagccatgcgcagggtcattcctgatgagctcatgcgcatccccggtattcatcatgtccttgcggttgaagatcgtgaatataccgatatccaccatatttttgagcagacgctggcgcagtatcgcgatgctcttgaaaacaaaacgttttgcgtgcgggttaagcgccggggcaaacacagcttcagttcgcaggatgtggagcgctatgtgggcggtggtctgaatcagcacatcgacagcgcgacggtacagcttaaaaagccgcaggtgacggtcaatctggaagtggaagaaaaccgtttaaccctggtcaccgcacgctatgaagggctgggcggtttcccgatcggcacgcaggaagacgtgctgtcgctgatctcgggcggctttgactccggcgtttcaagctacatgttgatgcgtcgcggttgccgggtgcactactgcttctttaatcttggtggggcagcgcatgaaatcggtgtgcgtcaggtggcgcattatatctggaaccgttttggccgttcgcatcgggtccgttttgtggcgattaacttcgagccggtcgttggcgaaattttagaaaaagtcgacgatggccaaatgggcgtggtgctgaagcgcatgatggttcgcgccgcgtcgatggtggctgaacgttatggcgtacaggcgctggtgaccggtgaagcgctggggcaggtatccagccagacgctgactaacctgcgtttgatcgacaatgcctctgatacgctgattctgcgcccgctgatctcccatgataaagaacacatcattaaggtcgcgcgtgagatcggcaccgaagattttgccagcaccatgccggaatattgtggtgtgatttccaaaagcccgacggttagggcggtaaaaggcaaaatcgaagccgaagaaagccattttgacttctcgattctggaacgcatggtggccgaagccactaacgttgatattcgcgacatcgctgagcagacccaggaagacgtcgtcgaggtggaaacggtcggcttactgaacgaaaacgacagcgtgctggatattcgctcggtggatgagcaggaagacaaaccgctgcaattggtgggcaccgaagtgaaatcgatgccgttctataaactcagcacgcagtttggcgatctcgatcagaacaaaacctggctgctgtattgcgatcgcggcgtgatgagcaagttacaggcgctgtacctgcatgagcagggttttaaaaacgtcaaagtttaccgcccgtaaggcgatccgagacagtatgactgtttcggcggtgcccgcgtccacctgagagtgatgcgggcaccgtgcccgctgtatctgctgtcttaacgcccaatcctaacttgcctgataatcataaatgccgggtgccagtaccaactgggctgcaacctcacgcgctttatcactgcctgctaataaatcaattaacttcagcgcaaagtccatcgccgtgcccggagcctggctggttaacagattaacccgtgagtcccatacgacgcgacgctccatccatttatcctccggtatcctgtctttcaaaccgggaaagcccgtcatatttcctaccggaaacaggttgtgcggcaccagcaccgtgccggccgccgcgcagatggcggcaacaatgcgtccagactgatggaactggcggacggtttccaccagcagcgggctgtcgcgaaacgtctcggctcctttcaggccaccgggtagcacaatggcgtcatagtcattgtccgcgacctcaaccagcggcacatcggccagcaaccttacgccgcgggaacagacaatttcccggcttccgtcgctttctacgctggcggtgagggtttttataccgccgcgaaccaggagatctagcgtggtcaccgcttcgatttcttcactgccatgagccagacagaccagtactgaggcgctcgcgcccataataagactccttgcgtttaatcatgtcatacaggcgcgtgttttctgtcaacactaagccgtgcgtgcgtgcgcggcgcaacagaaaaccggtaatgtactcaatttccgttagccgctgtgcgcgaatatcctgcaacatcgatgaggtgttggccgccgtggtttcaatcacatcaaagacgtgatcctgcaggctctgactggcaacggactggccttcgcgttccatcacccaactgatttcatcgcataacgtcgttatttcaccgctgtaatgacgcaacgcaccgttctgacagtcgtgctccacgctcagggcgttaatcacgcagttaaccgccagtttgcgccagcaggcggcgcggatgttgtcgtgccaggcgacgtcgggcagtgcgtcatgcaggatgtcggcaatctcacttccgccctcgcttttacggttgccggggccaatgtgcgtgacgccgttggcgacatgcttgatcaccgtgccgtctcgcatagcggcgtgcgtggtgataccgcgcagcagcggttgccgaagccctttgagttctcccagcgtgcccatcccgttgtgcagcagcaggacggggcagttttccgacatcacgctttccagatttttaacggcggtcgacacctgtggcgctttaagcgtcaccaacagcagttggctctgggccagaaacagcggatcgttagcgataaatgtccggtttgacacgcggcccaacggatcaatcacgttagcggaacagtagggctgagggacgcgcagccatccctgaacatcgtgtccgcaatgggcaagggcggtgagccagacctgacctagcgcaccacatcctaatacggttattttcatgctgcctcccgctcgcgggcttattatttatgcgctgtgacaatgagttaagtatagcgctgcacagcgtgattttatttagtgccgtaagacgcgtattatgcatgccagtttagcctcaggagaagaagagatgccatctttcgatatcgtttcagaagtcgacatgcaggaagttcgcaatgcggtagagaatgctaaccgtgaactggcaacgcgtttcgattttcgcaacgtcaccgccagttatgaactcaatgaaaaaaatgaaaccattaaagtcatcagtgaatctgactttcaggttaagcaactggtcgatattctgcgcgaaaaaatgctcaagcgcggcattgaaggcgcggcactggacgtgccagaagagattgaacacagcggcaagagctggagcctggatgccaaaatgaaaaaaggcattgaagccgatgtggcgaaaaagctggtgaaactgatcaaagacagcaagctcaaagtgcagacgcagattcagggggaatccctgcgcgtcaccggtaagtcacgcgacgatctgcaaggcgcgatggcgctggtgcgcggcggcaatttggggcagccgttccagtttaaaaacttccgcgattaaccgtatttattgcgtgcagcgcggcgatacagcgtgctgcgcgcaacgcctaacgcctgtgcggttttgctgatattgccgttaaactgctgcagcgtggcgtttatcagctgatcgtcatgttgctgacgcgcaggtaacgccggcgcttcctcgttacggtacgcttccggcaggtgcattatccccacggtttccccatcttcagccagcgccagcaagactttcatcaggctacgtagctggcgtacgttgcccggccagcggtaacgcgttaatgtcgtcatgacctcaggtgacaacccaatctggcgcgcatcgccgcccagttcaccccagagctgtgtgataaaggtcgatagcgaaggccagtcacgcagcggtggaatggttaatgaaaactcctgtaagcgataaagaagatcctcacgaaatgtgccctggctgacgcgctgggccaaatcccggtgcgttgcgctgatcacggccaggttcaccggccagctctgactggaacccaacggtgcgacctctttttcctgaagcacccgcaggagtcgggtttgcagcgccagcggcatatcgccaatttcatccagaaacaggacgccgccatcggcctcacgaattttgccgatatagccatttttgctggccccggtaaacgccccgggctgatagccaaacagctcggattcaatcagcgattctggaatcgcggcgcagttaatcgccacaaatttgcccgcacgccagcggctctgctgatgcaacgcgcggctcacgtactctttcccgctgccggtttccccgcgaatgcacaatgccactccggcattcaacaggcgcaccattttgtcgccctcattttgcagggagaaaggaagcggtggcgcaggacgtgcggcgacgctgaagcgcgtccgggtcggtgcccgcagacgatagtaataaggctgatggccggttattaccggcgtcggcagggccgtggcctgcaggttacgctggggaaacaactgctcaaaggtcgtgatgccaagctgctcggcgtgcagacccagttcacgcatcgccaggcggtttgcggcagtcagtacgttatccgaaaacaccagcagcaactcatccaggctgtcgagtttatgcacatcggggtgcaggctcatcagccactgctgcggatgcaggctttgcttaacccacaggtactcaatctgccgcgcggcctgctttacccaggcaaagctgtgatcgtgggagaaatgggcggggccggagatatccagcacgcccgcgatgtgtccgttgggcatttgcagcggcatcgcggcacagtaaaggccctggttgcgggtcaggaagtgttgattaccgtcaacttcgcatccatcgtctatcgccagggctgtgccaatggcgttcgtgccccggccacattcgctccagatgttgccgggagcgagggcaaagcgctgtgccttttgcatcgcctgcatatcaccaaacgtatgcagcacccggcccgcagcgtcagacagaatgaccaccgactgcatcggtgccaccttctgtgccagcttgcgcatcaccggctgagaaaactgttgcaggtcggtattgctggcgaccagttctgtcagctctgtctggggcaggcgaggaaaatcatcggccgaacgctccagcccgtagagttggctgcgtaaccaggaatcactcagcagtgggttattgtcgatagcgggcagtgtggcatcggaaaccttgtcctgcatgaatgacctcgtgcgttcggaaaagtgttgcggaattgtagcgtcttggtttttccagtgttgcgatttgcaacacaaagccggatgaaacccctgattctgcactgaacgttggtttgcctgatgtgcaggttcctgattattctctgttttaatgcgcttccccgcttcggcccggagttggcacaggccgtgcaagcgtcaggttacagcgagctgtccgttaaaaaaacatcatgccgctgcctgtctaccctacagaaggagtttgcaatgcgttatgcccatcccggttcaccaggtgcgttagtcacgttccagtctgcctacggcaactacattgatggcaaatttattgagccactgaacgggcaatatttcatgaatacctcgcccgtcaacggcagtgatattgctcactttccgcgctccgatgcacgcgatattgatttggccctggatgccgcgcatcgtgctgcagaagcctgggggaaaacctcggtacaaacccgatccaacctgttgcttcaggtggctgaccgcattgatgccaacctggaaaagctggccgtggcggaaagctgggataacggcaaaccgattcgggaaacgctcaatgccgatctgcccctggccgccgaccattttcgctacttcgcgggatgcctgcgtgcgcaagagggcagcaccggcgagatcgatgagaaaaccgtggcctatcactttcatgagccgctgggcgtagtgggacagattatcccctggaactttcccttgctgatggcggcatggaagctggcccctgcgctggccgccggtaactgtgtggtgctgaagcctgctgagcaaaccccgttgggcattacgctgttgatggagctgatcggcgatctgtttcctgccggggtgctcaacgtggtgcagggctttggccgtgaggcgggggaagcgttggcgaccagtaagcgtatcgccaaaatcgcctttaccggttcaacgccggtggggcgtcatattatggcctgtgccgcagaaaatattatcccctgtacggtagagttgggcgggaaatcccccaacatctactttgccgacattatgaacggcgagccagattttattgagaaggcagtagaagggcttgtgctaggcttttttaatcagggcgaagtctgtacctgtccttcccgcgcgctcattcatgagtctgtgtatgcgcctttcatggagcgggtgatggctaaagtggcgacgattcggcgcggcgatccgctcgacaccgacaccatgattggcgcgcaggcttcgcgtcagcagttcgataaaattttgtcgtatatcgagattgcccgcaacgaagggggcgagatcctgaccgggggtgagcgggccttgatatcgtccgaactggataacggtttctatattcagcctacgctgattaaaggcagcaacaacatgcgctgctttcaggaggaaatttttggcccggttatcggtgtgactacctttaaagatgagtcagaagccttgcgcatcgccaatgaaacgcagtttggtttaggcgcgggcgtctggacgcgggacagcaatttagcctaccgtatggggcgcgccattaaagccgggcgtgtctggaccaactgttaccacatctatccggcccacgccgcctttggcggttacaagcaatccggtgttggccgtgaaacccataaaatggcgctcagccagtatcagcaaacgaaaaatttgctggtcagctatgacacggcaccgctggggctgttttaagtccgtaacctatctggagcgtaaatcatgacgatgaaaatcaacacgatgatgaaagccgcggtcgtgaaggcctttggtgagccgttagtcattgagcaggtccccgtgccacagccgggcgcaggacagattctggtgaaaatcgcggcgacgggcgtgtgtcacaccgatctgcatgcggcagagggcgactggccggtgaagcccgttcctccctttatcccgggacatgagggcgtcgggcaggtggtcgcggtgggtgataacgtacatcatctgaaggtgggcgatcgggtcggcgtgccctggctctactccgcctgcggtcactgcgagcactgtctcgataactgggaaacgctgtgccatagccagcaaaataccggctattcggtgaacggcagttttgccgaatactgcgtggcggacgccaattatgtcggcatcatccccgaaaacctcgcattcaacgaggtggcaccggtgctctgtgcgggcgtgacggtctataaaggtttaaaaatgaccgacaccaaacccggtgactgggtggtgatttccggcatcggtgggttagggcacatggctatacagtatgccgtcgcgatggggctgaacgtggcggctgtcgatatcgatgacgataagctggcctttgcccaacgccttggtgccagcgtggtggcgaatgccagaaacgtcgatccggccaaggtgtttcatgagcactttggcggcgcgcacggcgtgctggtcacggcggtgtcgcctaaagcctttgagcaggcgatcggcacgttacgtcgcgggggcaccatggtgttaaatggcttgccgcctggcaaattcgatctgtctattttcgatatggtgctggacggcattacggtgcgcggttctatcgtcggaacgcgtaaggatttacaggaggcgctggattttgccagccgtcataaagtgaaagccagcgtggcgattgaaccgctcagcaatattaacgatatctttgcccggatgcatgcaggcaagattgaaggccgtattgtggtggatatgtcattgtaaacccgaggcaggatgcgatgactacctgatgaaaaaaggtgccagcgttaaacgcggcaccttaatgcatctgggctgttaccgcgtatctgacggcaactgaggtaatcttcccctgccaacacagactttgcagcccgttttaacaactgccgatgagtgcttccagttcaggacgactggtgactttactgtctatcttgatgtaggcgcttttctcttccggcacaatcagcaccgatgagacgccaggctgtgcttttaaccgcttttccagattaggcacagccagtgcggcatcgctcaacaccaggcgcaaactgctgacataaggcggttcctgcattgtcatactgacaaacagccaggccgcggccacgatcgcccccaccataaatacggtttgcgcatcgaaatggccaaacagccaaccgcccaggctaccgccgatggcgacgcctaaaaactggctggtggaataaagccccattgcggtgcctttataaccggcaggtgactccttactgaccagcgaaggcagaatcgcctccatcaggttaaacgccaggaagaacagctgcacgccgacgaccagcgtccagaaatgcccctgcgcgccccataagacaatttctgcgatgaccatcatgccgacgcagccgacaaaaacccgcttcatgcggcgtttaacttctgcataaatgataaagggcacgacgcccgcaaacgcaatcagcatggtggtcagatacactttccagtgttccgacggcggtaagccagcctgttcaaactggtcgggcagggcgataaagctcgacatcagcagaatgtgcaaaaagaaaatgcccaggttcagtttgaccagccttgggttggccagcactttgctaaagctgccgcgcaccatgcccgactcacgattaagcacgtgatgagaggaggagggcacgatccataaggtaatcgcaatccccattgtcgcaaggagcgcgatcatccaaaacaaggcatgtaagcccagcttgtgggtcactattggacctaagaccatcgcaatggcaaaggtgacgccaaagctgatgccgataaacgccatcgctttggtgcggttctgttcgcgggtcaaatcagacaggagtgccatgacggcggcggcaatcgccccggaaccctgcagtgcacgtcccagtatgatgccccaaatggacgccgtgctggcagcaatcacgctgccgagtacaaacagcagcaggccgcccacaatcaggggcttacgcccaatgcgatcggacagcaggccaaaggggatctggaaaatcgcctgtgccaggccgtagatgccaatggccaggccaattaaggtttcactcgcgccctggagtgccatgccataggtggtcaataccggcaggaccataaacattcccagcatacgcagggaaaagaccgtgccgaggccccacgtggcgcgcagctccaccggagtcattttgttatcgttcattccaacctctgttgttgtgctgcgtttattctagggagggagagcgggcgggtaaaacaatagttcttaagcagtggtaacaaaaagaaaaggcgcgaaaatcgcgcccgtttcatgctgttttagtacacattaacgcacgtaggtcagcaggtctttcgaggctggcgtcataaaatcaaccgacatcatgacgctcagggccgtaatcgccacaatcgagaagacgaacagcttacgtgcccaaacccgatcgtttgaggttttatagcctgacagcgccattcccagccaccacacgctaacagcagacgcgacgatcagatatttgtagcccgcgtagccgcccagcgtcagcatcagcgtggcaatcataaacgccaggatatagagcgtaatgtgattttttgccacggaaatgcctttcaccaccggtaacaccgggatgttggcagcctggtaatctttaaagcggaagatggcaatcgcataggagtgcggcatctgccacaggctaaagatagccagcaggattaaggcaccggcatcaaactcattggtcactgcacagtagccaatgaccggcggcgcagcgccggacaggctaccaatcagcgtaccgtagacggagtgacgcttcatatacaggctgtaaatgccaacgtataccacgaagcccatcaccgccagccacatggccagcgggttagcaccgaaatacagcagtgcaaagccagcaatacctaacacagtggcgtaaaccaggctaactttcgcggagataaggccttttaccagcacccgattcctggttctctccatcttgatatcaatgtcacggtcgatcacgttgttgaaaacacaacctgatgcaacaaccagcgacacgccaaccagtgaggtgagaaacagggcgtaatcaatgctgcccttagaggccagcaaaaatccgccgatcacagaaattaaattcccgaaaataattcctggctttgtaacttgcaggtattgcttaaacattacacagactctttagtggggcatcatgttgtagttgaggttccacatgatccacagtgagccaacgacaacaatcagaataatgattgctgagaagacaatggccaccatgttccagccaccttcagatttgctgtccagatgcaggaagtaaaccaggtgaaccagcacctgaactactgcacagaccagcacaacaccgaggatggttccatgagaagcgctgccatccattaccatccagaacgggattcccgtcaggatgatagagaggatgaagccgatcatgtaagacttcacgctaccgtgtgatgcaccatgttcgttaacagaatgactcattacatggctcccatcagataaactacggtaaacacgcaaatccaaaccacgtccaggaagtgccagaacaggctcagacacatgatacgggtacggttagtggcgttcagaccgcgtttcgcgatctggaacatcagcacggccatccagattaaaccagaggttacgtgcagaccgtgagtaccgaccagcgtaaagaagccagacaggaaaccactgcgatcaggaccaaagccttcaacaatcaggtgatggaactcatagatttccatcccgatgaagccagcaccaaacaggaaggtcaacgccagccagccgataacggtgcctttgttttccttgttcatggcgataactgccatgccgtaggtgatggagcttaataacagcagggcggtttcaaccagcacgaacggcagttcaaagatatctttgcctgccggaccaccggcggtgctgttaaccataactgcataggtcgcaaacagcgttgcgaagataatgcagtcactcatcaggtagatccagaagccaaagactttattggctcctgcatcgtgatgcccatgctccgcatgggcgtcgtggtggtgttttacggtttcagttgacattatttcagacctgctttgctgatttcgtcaaagtgctgcttttcaatcttctctacttcggcaaccggaacgtagtaatccacgtcttcgtcgaagctcttcacgatccaggttacgatcatgccgaggaaagaaagacctgccagccaccagatatgccagatcatcgcaaaaccgaagatggtcgcaaacgcggcaataacaatcgcagcaccgctgtttttcggcatatgaatttcttcataatgagccggttgcttgtacgcttcgcctttctctttcatttcccagaaagcgtcacgctcatgcacatgcgggataacagcaaagttgtagaacggcggtggtgaagaggttgcccactccagcgtacgcgcgccccatgggtcaccggtcagatcgcggttctggtcgcggtcacgcacagaaacgtagaacataatgatctggcaaaggataccgcatgcaatcagtgccgcaccgcctgccgctaccaccaacagagggtggaactgcgggtcgatgtcctggctcagacgacgcgtcatccccataaagcccagaacgtacagcggcataaaggcgacgaagaagccgataatccagaaccagaaggcacgcttgccccaggtttcgttcagcgtaaagccgaacgctttcgggaaccagtaagtcacgcctgccatacaaccgaataccacaccaccaataatcacgttatggaagtgagcaatcaggaacagactgttgtgcagcacgaagtccgcacctggcaccgccagcagaacaccggtcataccaccaacagagaaggtgaccaggaagcctacggtccacaacatcgcagagtgcatctgaatgcggccctggtacatggtgaacagccagttaaagattttaaccccggtaggaatggcgataatcatcgtcataataccgaagaaggcgtttacgttcgcacccgcacccatggtgaagaagtggtgcagccaaacgatgaacgacaacacggtgatggcgatagttgcccataccagtgaggtgtaaccaaacagacgttttttcgagaaggtcgcagtgacttcagagaagacaccaaagaccggcagaacaaggatgtacacctctggatgaccccaaacccagatcaggttgacgtacatcatcatgttaccgcccatatcattggtaaagaaatggaagccgaggtaacgatcaagtgtcaacagtgccagcgttacggtcagaaccgggaacgcagcgatgatcaggacgttggtgcagagggaagcccaggtaaataccggcattttgaacaggtccatgcccggcgcacgcatcttcagaatggtcacgaagaagttaataccggtcagcgtggtaccaataccggagagctggagactccagatccagtagtctacccccacgccaggactgtattctgcccccgacagcggtggataggccagccagccagtttgtgcgaattcaccgacacccagagacaggttaaccaggattacaccaatcgcggtaaaccagaagctcaggttgttcaggaacgggaaggcaacgtcacgcgcaccaatttgcaaaggtacggcaatgttcatcaggcccacgacgaacggcatcgccacgaagaagatcatgatcacgccgtgcgcggtgaagatctggtcgtagtgatgcggcggcagtatgcctgcttccccggccgaagccagaacctgctgggtacgcatcattaccgcatcggcaaagccgcgcagcaacatgacgaacgccatgatgatgtacatgatacccagttttttgtggtcgatggatgtgaaccattctgaccacagatatttccacttaccgaaataagtgatggcagcgacaagcgccagacctgcgatgatgataccggcaaccgtgaccatgacaatcggctcatggaacggtaccgcatccagtgttaattttccgaacatcgtattattcctcggctcccgcggtagcggtgtgactcatgtccatgcctttatgctcaggcatgtccatcttcccgtggctatgcatgaacttgttgatgacctgcaagaacagttcaggattagcagaagagaaatattccaccgggtgattttcgcttggtacggctactttctcgaaatcatccatcgttgtcagcgtgttaggtgccgctttaactttagcaacccactgctggaactccgcgtcgtctttggtggcaatggctttaaacttcataccagagaaaccgcgaccactgaagttggcggaaataccgtcgaaagttcctggctcgttggcaatcagatgcagtttagtctgcatgcctgccatcgcgtagatctggctaccgagcgtaggaataaagaaggagttcataacggaattagaggtgattttgaagttaaccggtgtgtttgccgggaaggcaatctggttaactgtcgcaataccttgttctggataaatgaacagccatttccagtccagggcaatcacatcaatctcaaccggtttcacgtctgacgccagcggtttgctcggctccagggcgtgggttgatttccaggtcagcacaccaaggaaaacgatgatcaggatcggaatggtccagaccacggcttccactttgttagagtgtgaccagttagggctgtatttggcattagtgttcgacgcccgatatttccaggcaaacaccacggccatcaagactgcaggtatcacgacgatcatcatcagaccaaaagcggtcagtatcagcgaacgttgctccagcgcaatctgtcctttgggatttaacaatgcattatcgcagccactcattaataaagtgcctgcgattaatgacaaaatccccaaacttttattgtatttactgagtctcatttaacgacctcaatgacaaagggctctattgtcgtttaagtgtgcgcgcattttacgggaaggtttatgcagtgtaaaccagcttaaggatgtgtcagaaccatgttgacaccttttgctaagggtgtcacagatgttgttctcggtgacaaattattaacgtggacaagcagttggcggcaatataacaaaaagagatggatatagggttaaacaaaagtggtaatggtataaccctgactttaatcacccaattatttaacaatattgcatcatttattcgattaattttaacctaattaattgcgcaccggttttaaatattctgatcgaatgcacccactgaccgaaatatttttttgtaaattgacacgcaaagacaaattaggcgcgcttaaccgactgtgcgaaatttaaccaaaatcccaccctgttagcgaatgccgggaagatcatcacgctgatgcagcgagcgataatccagcaccacgccgcagagtacaccacagagtgccaacgtcatgccggcttcaaacagcgggaccagtgctgtcgacagacggggtaagcccgctgcattcagcgccagtgccagcagccataaagccagcaacccgcagccgctggcgaacagccggtttgtccagcggtagcccgctgcgaaacgggtacgcggcaaaaactgcccggttgtttgtgtgaaatccagcgtgccacggcaaaatgctaacagcaccagacccggtaagccagccagtaccgtaaacgcatagaaggtcggccagccccacagttcaactaagaagcccgccgcagggccaacgtaaacccgacctaccgccgacagggccgacagcagcgcgaactgcgttgccgaaaaggacttattgcacagcgtcatcagcagcgcgacaaacgcagccgtgcccataccgccacacaagttttcgataaatactgcgcctgccatgctccacagatgcttgtcggtgactgccagcagccagtagccaaaattagataccgcctgtagcaggccaaaaatcatcagcgcgcgaaacaggctcaggcgctgcatcagcacgccgccatacagcgccccgatgatagtcgccagcaggccgagtgtcttattaaccaacccgacatcgcccggattaaagcccacgccgcgaattaagaaggtggtagtgagcgaggcggcaaacgcatcgccgagcttgtaaaggatgatcagcgttatcagcagccaggcattattacggttaaaaaagtctcgtaggggatcgaccaccgcctgacgaagcgactggggcgcggactgtcggttatccggctcgttagccataaaggttgcgacgatgcagggaaccagtaacagcgccatcagccagtaagttgcccgccagcccagatagcgatcggccagccacagggcgagtccacccgatatcaacatagccagtcggtagcctaacaccgtgatagccgcgccgcttccgcgttgctccggtggcaaaacgtccgtcttccaggcgtcaaacacaatatcctgagacgcggaacagaacgcaatcaacaccgccagtgccgccatcagggtcaaatcccggctgggctgcataaatcccatcgcgatgatgctggcgaccagcgctagctgggtgatcaataaccaccctttacgacggcccagaaacggcggtgtgtagcgatccatcatcggtgaccagagaaacttaaacacgtaagcctggcccacgagggaaaagaaaccgatggttttcagatcaatattatcaacggtcatccacgcctgtaaggtcccgctcgttaatgccaggggcaaacctgacgcgaatcccagaaggagcaacacagcggcatttttttgacggaagacgcggaaatagtgattcatactgaccttgaaaagcgcccggcatcatgccgggcgaggggcaaaattagtgagagttttgtttaataaattcgttgacgctggtgtcctgcgccatatcggcaatcacatcgctcagcgttgagttcaccgcgttggtgattttctggttactggcgctgaaggcaccttctacgctgtaggtctgacggtagtttttaatctgcttgttgccgtttttcgcggtggcaacaatagagatatctgccttggtcgtaatgctgtaacgcacgtcaccctgggtcacgtcggcatacagattattaacaatgatttgcagatcgactgcgccattggggccgaccatatagccgcgtgccgtcatctgtttttccagcacttcctgcagtaagaagcgcaggtcgcgggacggtgtgaggctgaccagttgcccgtcgcggttcacttttgccagcgcctgatcgcggcgttggtcagcaccgttgatacttacggtgacgcccatcaagctgggatcgcgttgcggcagctgaattttaggttgaatcgtcagtgtgttgttgctggaagcacagccggccaggataaaagcagccagcagtgggaataacagttttttcaacatacgctttctcgttaatgtaatgggttggtgtgcaaaaactgcggccatcatagcaaagcggtgcagtgaataaagcccccagcgcgaggtaaagtcacgcaacggtgtttcgtccgcgttgtgttgcgtaaaacgacgacccgataaggcgcgcgcgcagaaaccgcgggaatgataatattctgcgcgccatcgcgtagtgtggcagaaaaccgactaatatttaaacagatggggcaccgcgctcgccattgagggtaaaaccatgattcgagaacagatagaagaaaagctgcggctggcttttgcgccggctcatctggaggtccacgatgaaagctaccgacacaatgtgcctgcgggttcggaaagccactttaaagttgtgatcgtcagtgacagttttaccggccagcgtttcctggcgcgtcatcgggcgatttacagcgaactcagtgcagaactggcgggaagcgttcatgccttagcgctgcatacgtacacgcttaaagagtgggaaggattgcaggatacggtcctggcgtcacccaactgccgcggtgccggaacgctagcctgagtgcaccgtttttggcgtttaattgtggctaaacgcgatctgcggctcaaaaaagcagcaaactccctaaaaagtggtgacttagcatcctcgactcatctcagcgatgccgctataatgctgcgtctatttttccggaatgtcttcgggacgcttctggtaacagggatcaggttctcttcacggaagccgtcccggttgttagatacggcgcattaaccaatgtgtggtgtctgaagttgaccgagcacgtgattttttgaggtaacaagatgcaagtttctgtagaaaccactcagggcctgggccgtcgcattacgattactgtcgcttctgacagcatcgaaagcgctgttaaaaaagaactggtggatgtggcgaagaaagtccgtatcgatggtttccgtaaaggcaaagtgccaatgaacatcgtggcacagcgctacggtgcgtctgtgcgccaggacgtgctgggcgatctgatgacgcgtaactttgttgacgccatcatcaaagagaaaatcaatccggctggcgcacctaactacgtgccaggcgaatacactgaaggtcaggactttacctatgcggtagaattcgaagtgtatccagaagttgagctgaaaggcctggaaaacatcgaagtcgagaagccacaggttcaggtcactgacgctgacgttgataccatgctggaaaccctgcgtaagcagcaggctaactggattgaaaccgacgccgctgcgggcgcagaagaccgcgcgactgtcgattttaccggttcagttgacggcgaagagtttgaaggcggtaaagcctcagatttcgttctggcaatgggccagggccgcatgatcccaggttttgaagaaggtgttgtgggtcataaagcaggtgaaaccttcactatcgatgtgaaattccctgatgactaccatgctgaaaacctgaaagggaaagacgctaagttcgaaatcgtgttgaagaaagttgaaacgcgcgaactgccagaactgactgaagacttcatcaaacgtttcggcgtagaagatggctcagttgacggtctgcgtgccgaagtgcgtaaaaacatggaacgcgagctgaaaggcgctattcgtaaccgcgtgaaaacgcaggctatcgacggtctggttgacgctaacccaatcgacgtgccttctgcactgatcgacagcgaagttgacgttctgcgtcgtcaggctgcacagcgcttcggtggtgatgagaagcaggcgctggaactgccacgtgaactgttcgaagagcaggcgaaacgtcgcgttgttgtcggcctgctgctgggcgaagtgattcgcacccacgagctgaaagcggacgaagatcgcgtgaaagtgctgatcgaagagatggcttctgcgtatgaagatccgcaggaagtgatcgagttctacagcaaaaataacgagctgatgaacaacatgcgcaatgtcgcgctggaagagcaggctgttgaagccgtgctggcaaaagccaaagtctctgagaaagaaactaacttccaggaactgatgaatcagaccgctcaggcctaatcgtccgtttaaccggttgtgctgaagcccgcgcctgaaaagtcgcgggcttttttctgtatcaggcttgctgtctgccggtttgccgctatttggttaatttttgggcaaattgttcacgcatcgctttttccgggttagcgattgatgaaaaggttgttatgcttgaaacaactgagcagcatcccaagatacagggagtatgcaaaaaacagttcggctgactgattaaccgtccttgagttgtcggtaagaggcagagcatagtttttgacgctcgtcttacgtaaaatcggtacagaatgttgccaatgaaatttatccaggagacggtaatgtcatacagtggcgatcgtgagtttactgcaccgcacaatgcgttggtgccaatggtggtcgagcaaacctcgcgcggcgagcgttcatacgacatctattcccgtctgcttaaagagcgcgtaatcttccttaccggtcaggtagaagatcacatggcgaacctgattgtggcccagatgctgtttctggaagcagagaatccggaaaaagatatttacctttatatcaactcaccgggtggcgtgattacggcagggatgtcaatttatgacaccatgaagtttatcaagccggacgtcagtacaatttgtatgggccaggcctgttcaatgggggctttcctgttgacggccgggactaagggcaagcgtttctgtctgccaaactcacgcgtaatgattcaccaaccgctgggtggctatcagggacaggcgagtgacattgaaatccatgcgcgcgaaatcctgaaagtgaagcagcgcatgaatgaactcatggcggagcacaccggtaagtcactggaagaaattgagcgtgataccgagcgtgaccgtttcctctccgccaacgaagcggtagagtatggattggtcgattcaatcctgacccatcgccaataagccctaacttcgccttgtctctggtctatagttaacaggacagggttataatgggttgaatgaacatcggccgtgtacccacggccagtgctgtacccctggtacggcctgagaacaagaagaggttaactgatgacagataagcgcaaagacggttcaggaaagttgctgtactgctctttttgcggcaaaagccagcatgaagtgcgtaagctgattgccgggccgtcagtgtatatctgcgatgagtgcgttgatctgtgtaacgacattattcgcgaagagattaaagaggttgccccgcatcgcgaacgtagtgcactgcctacgccgcatgagattcgccatcacctcgacgattacgttattggtcaggaaagggccaagaaagtcctggccgtggcggtgtataaccactacaaacgtctgcgcaacggggataccagcaacggaatcgaactgggcaaaagtaatatcctgctcatcggtcctacaggtagcggtaaaacgctgctggcagaaacccttgcccgtttactggatgtgcctttcaccatggcggatgccaccacgttaaccgaagccggttatgtgggtgaagacgttgaaaacatcatccagaaactgctgcaaaaatgtgactacgatgtgcagaaagcacagcgtggtattgtctacatcgatgaaatcgacaaaatttcacgtaagtcagacaatccttctatcacccgtgatgtgtcgggcgaaggggtacagcaggcgttactgaagctgattgaagggacagtggctgcggttcctccgcagggcggccgtaaacatccgcagcaggagtttttgcaggtcgatacctcgaagattctgtttatctgtggcggtgcgtttgccgggctggacaaggtgatttcccagcgcgttgaaaccggttcgggcatcggatttggtgcaacggtaaaaggcaaatcgcaaaaagcaacggaaggcgagctgctggcgcagtgtgagccggaagatttgatcaaatttggtctgatccccgagttcattggtcgtctgcccgtcgtcgcaacgctcaatgaactgagtgaagaggcgctgattcagatcctgcgtgagccaaaaaatgcactgaccaagcagtatcaggcgctgtttaacctggaaggcgtggatctggaattccgtgatgaagccctgacggcgattgctaaaaaggcgatgtcacgtaaaaccggtgcgcgtggtctgcgttcgatagtggaaggtgcgctactggaaacgatgtacgatctgccctctatggacgacgtcgagaaagtggtgattgatgagtcagttattgaaggtcagtccgaacctatgctgatttatggcaagcatgaagctcaggcttctggcgaataaataaacaaatcgtccacattgtgccatctaaaaaggggaaaatctttccccttttgcatttctcaccgttgtgacattgaatgtctgacaatcatccccatatactcagacacctgtgggtttgaccgcatacctgcctgatgcggtacccatcacctggcggacactaaactaagagagagctctatgaatcctgagcgttctgaacgcattgaaatccccgtcttgcctttgcgcgacgtggtagtttatccgcacatggtaattccgttgtttgttggccgggaaaaatcaattcggtgcctcgaagccgcaatggatcatgataaaaagatcatgctggtcgcacagaaagaggcttcaacggatgaacctggcataaacgatcttttttcagtgggtacaattgcctccgtcctgcagatgttaaaactgccagacggtacggtgaaagtgctggttgaaggcttgcagcgtgccaacatcactacgcttgctgacaacggcgaccactttgtggcccaggctgaatatctggtctcaccagagatcgaagagcgcgagcaggaagtgctggtgcgcacggcgatcaatcagtttgaaggctacatcaaactgaataaaaagatcccacctgaggtcttaacctcactgaataatattgacgatgcggcacgcctggcggatacggttgcggcgcatatgccattgaaactcgcagataaacagtcagtgctggagatgtcagacgtgaacgaacgtctggaatatctgatggcgatgatggaatctgaaatcgatctgctgcaggttgaaaaacgcattcgcaaccgcgttaaaaagcagatggaaaagagccagcgtgagtactatctgaatgagcagatgaaggccattcagaaagagttgggcgagatggatgatacgcctgatgagtacgaagcattaaaacgcaaaatcgatgcggccaaaatgccgcaggaagcgcgtgaaaaagcggaagctgaactgcagaagctgaaaatgatgtcaccgatgtctgcggaagcgacggtggtgcgtggctatatcgactggatggtgcaggttccatggaacgcgcgcagcaaagtgaagaaagatctgcgcaaggctcaggaaaccctggacattgaccactacggtctggaacgcgttaaagaccgcatccttgaatatcttgcggtgcaaagtcgcgtcagcaaaatcaaaggacctatcctttgtctggtggggccgccgggcgtcggtaaaacctcgctgggtcagtccattgcgaaagccaccgggcgtaagtacgttcgtatggcattgggtggcgtccgtgacgaagcggaaatccgtggtcatcgccgtacctatatcggttcaatgccgggcaagttgattcagaaaatggcgaaagtgggcgtgaaaaaccccctgttcctgttagatgaaattgacaaaatgtcatcagacatgcgcggcgatccggcatcagccctgctggaagtgctggacccggagcagaacatcgcgtttaacgatcactatctggaagtggactacgatctctccgatgtgatgtttgtggcgacctctaactccatgaacatcccggcaccgctgctggatcgtatggaagtgatccgtctgtcgggttataccgaagatgagaagctcaacattgcgaaacagcatttgctgcccaagcagattgagcgcaacgcattgaaagcgtcagagatcagcgtcgatgacagcgcgatcgtcggtatcattcgttactatacgcgtgaagccggtgtgcgtagcctggaacgtgaactgtccaagttgtgccgtaaagcagtgaaaacgctgctgatggataaaaccaaaaagcacatcaccattaatggtgaaaacctgaaggatttccttggggttcagcgctttgactatggccgtgccgacagcgaaaaccgtgttggtcaggttaccggtctggcctggacggaagttggcggtgatttgctgactatcgaaaccgcctgtgtgcctggtaaagggaaactgacctataccggatcgctgggtgaagtgatgcaggaatccattcaggcagccttgaccgtggtacgcgcacgtgcagaaaaactgggtatcaacggcgatttctatgaaaaacgtgatatccatgtgcacgtaccggaaggggcaacgccaaaagatggtccaagtgccggtattgcgatgtgtactgcactggtgtcctgtctgaccggtaacccggtgcgctctgatgtagcgatgacaggtgagatcaccttacgcggtcaggtgttacctatcggcgggctgaaagagaagctgctggcagcacaccgtggtggcatcaaagtggttttgatcccggacgagaacaaacgcgatctggaagaaattccacagaacgtgattgccgatctggaaatccatccggtcaagcgcattgaagaagtgctgaatctggcactggaaaatgcgccttacggcatgcaggttgctaccgcaaaatagtgattaatggcataaaccgttaaaaagcagagctggcaacaccaattggtgcttgccagcttttttttgtgccgttaatttaggttgctgctggactgacgttataagaggattaccgttgtttcagctaataaggcttgatataacttgctgcgcgttcgtacccgacaggaagcgtgggtacgatgtgaaataataaagaggggatgaatagagtgaataagtcacaactgatcgataaaattgctgccgatgccgacatttctaaagcagcagcaggacgtgtgttagatgcatttatgggctctgtttctgatgcgctgaaaggcggagatgaagtggcgctggtgggtttcggcactttctcagtacgtgagcgcgcagcgcgcacaggccgtaatccgcaaaccggtaaagagattactatcccggcaggtaaagtaccgggtttccgtgcaggtaaagcactgaaagacgctgtcaactaatgacaacgccaccactcattaacacattttcttgagtggattagaggacggttaacgcgttctcatgtaacatacgggcacatcgatgagatgtgccttttttatatccagagaggcagtaaaggtcgcaaggcttgtctcaacaggattattgctgccagccagatttgcagctgagtaatgcgccgggaagatggcgttattgcgacagggctttacattcacactacagcggagtgttgtcataccatgatggacaatttacgcgcggcgtcgaaccatgtcgtgctcaagattattttggggttgatcattctctcctttgtgctgaccggcgttggcaactatctgattggcggcaacaatgattatgcggccaaagttaacggtcaggagatcagccgggcgcagttagatcgggcatttaacagcgaacgaaaccgtcagcagcagatgctgggcgatcagttttcacaactggcgggtaacgacggttacatgcagcagatgcgccagcaggcgctgtctcagctgatcgatcaggctttactggacacctacattaaagatctgcacatcgccatcagtgacgatcaggtcaagcaggctattttcaatcaggccgctttccagaccaacggtaagtttgataacgccaaatataacgcgatgattaccgatatgggtttcaacgctgaccagtacgcggaagcgctgcgtaaacaactggccacccagcagttgattaacgccatcgcgaacaccgactttatgcttaaaaatgaaaccagcaagctggtggatttggtggcacagaagcgtgatattcagaccgcgacgatcgacgtgaatgcgctggcggcaaagcaaaccgttaacgatgacgaaaccagccagtactatcagcagcataaaaacagctttatggcccctgagcagttccgggtcagctatatcaaactggatgccgccggtatgcaggaaaatgccagcgatgcggatattcaggcctggtatgataaaaataaagcggactacacgcagccacagcgcgatcgttacagcgtgattcagaccaaaacggaagccgatgccaatgcgattttggctcagctgaagagcggtgctgattttgccgggctggcgaagaccaaatccatcgacccgatttctgcccgtaaaggtggagacatgggttggctggagccgtcaaccacgccggatgagctgaaaaatgcagggctgaaagagaaaggccagctgtcaggtgtgattaagtcttccgttggcttcctgattgtgcgccttgacgatatcaagcctgagcaaatcaagccgctggctgatgtgcgcagcgaagtggcggataaagttaagcaggaaaaagcgctggacgctttctataaactgcagcagaaggtgagcgaagcagccagcaatgacaatgagtcgctggccggtgctgagcaggcgtcaggcattaaagccacagaaacaggctggtttaaccgtgatgacgtgccaaaagatctcgacttcgacgcggtgaagcaggctatttttaacggcggccttgttggtcaaaatggcgcgccggggaataactctgacatcatcagtgtcgatggcgatcgcgcttttgtgttgcgtatcagcgagcataaacctgaagcggtagagccgctggaaaaggttaaagcacagattgtcgatacgttgaaacacgataaagcgacgcagcaggcaaaagcccgggcagataaactgttagccgacctgaaagccggaaaacaggatgtgctaaaagccgcaggcctgacgctgagcgccagcaaaacggttgatcgtaattctcaggacccggtggcgcaggcggcgtttaatctgccacagcctgcggataacaaaccgtcctggggcgtaagcgaagatatgcagggcaatgtggtactggtggcggttaataaagtcagcaccggtagcatgcctcaggctcagattgatgaaatggtcaaaggtgtcacgcagaacaatgcgcaacttgcctttgaagcattgctgcaaaatctgcgcaaagaggccaaaattaaatacggtgctgctgcccagatgcagtaatcctcgcaaaattcaggtaatcactgaaacgactaaaggccgcttatgcggccttttccatttctgtcgtttgcgctttgagtccattttaccgacatgacaacctgagcctgctgtttaacacaaggagaaacacagcatggctaaaaccaacttacaggccttttatctttccctcgctctgtgtggcgcactgtatcaaatgccactgtcagcggcagaaaccccaagtgaaacgcaggccgctcaggtttccctgccgcatcaggagcaggtcagtatcaacgacgcgacggcagaacagctctcgtcggtgatgaacggtgtgggtctgaaaaaggcgcagtccatcgtcagctatcgtgaagaatacggcccgttcacggccatcgatcaacttaaagatgtgcccggctttggtaatgctctggtcgagagaaatgcgtcgcgtctgaaattgtgaggtaaggcgcaactctgatgcttaacctgctggcctggccggactctgctaaagtgaacaggtccaaccagttaatctttagcagcaggagaacaggaatgcagaccacaataaaagtgcgcggttatcatctggatgtttatcagcatgttaataatgctcgttatctggagtttttagaagaagcgcgctggcaatggctggaggaagcagacgcttttaactggctgcttgagcaaaaactggcctttgtggtggttaacatcaacatcaactatcgtcgcccggcggtgctgggcgatgttctggagatcagcagcgagatgacgcagctcaatggaaaaagcggcattatgtctcaacgtattcttttagccggtggggataccgtggttgcggatgcggcactgaccttcgtgtgtatcgatcttcgttcacaaaaagccgttccgcttgaaggcgaagtacggcagcggctggaaaaattaataacctgactgacaggatcaacgcggcggcaatcgttagccgccgctcacgtctttactgtaaaccggtttttgccttcatggctgacatgatgccgggactatcctgcagataagccttcagaccttttgcgcgcagatgacaggcggcacattcgccacagccgtcacctttcacgccgttatagcaggtgagcgtctcttcacggattagcgtgagctgctgccagtaatcggccagcgcccaggtttcggccttatcgagccacatcagcggggtttcaaagcggatatcgcgcgccatgccaagcgtgacggcgtggttaagcgctttaacaaactcatcgcgacagtcgggataaccggagaagtccgtttcgcaaacgccggtgatcaccgcctcagcctcaacttgataggcgtaaacggaggccagagtcaggaacagaatattgcggcccggcacaaatgtgcttggcaggcccgttgcctgcgggtcataagcaggaaccgggatgttgtctcgcgtcaggctactgacggccagctcattcagcatggtcacatccagcactttatgcgcccgggcgcccagttttaacgcaagctcacgcgctacctcaatctcttcacggtgacgttgaccataatcgaaggtcacgcagtgtacttcatcgtaaagctgtaaagcctgaaccaggcaggtggtggagtcttgtccaccgctaaataccacaacggcgcgtttcatggctcgtcctaataacaaaaattggtgcttatggtaatacctcagggcgttgctgaacagctgcaagcggcggtcactatcaggagaataccaatgaacgctggtcctcaacggtttccgcagcgcggcggtcccctggtaacgggtacagcacgcgctcagattagtaccgtggggctggcgagaagcctaaccgcgtcagcggaaaggggcaggtgagggcgtcaggtgacgtcagtggaatgggcgctaaacagattgaggccggcagcgtcaacaggatggacttgtcatcgctgagcctgccagacacgagccacgaaccccggcaccctggttactccggccgctgttatccaacccgcatgccagaagacaggcttgatcgccacctcaggccagctcatgctgccatggcgcaatctcgccaatatgctgagccacccattcgggttgatagtaggtatcaagataacgttcgccactgtcgcacaggagcgtcaccagcgagccttgctcgttgttatcgcgtaagcgttttgctacctgcatcatgccccaaaaattcgtgccggtagaggggccaggtttacgtcccaacagggtttccagcttcagcatggcggcaattgttgcgccatcgggcactttgatcatttcatcaatcacatcaggcataaaggagggttcaacgcgtgggcgaccaataccttcaatcatgctgccgcgattgctggtcagagtggcatcacgattttgccagtagtcataaaaaaccgaatgctgcggatcgaccaccagtaagcgcgtatcgcatccctgatagcggatatagcgccccaatgtggctgacgtaccgccggtgcccgcgctcataattaacgtatgaggaacaggaaaaggctcgttcgccatctggcggaaaatactttcggcaatattgttgttgccgcgccagtcggttgcccgttcagcataggtaaactgatccataaagtggccgttcagttcccgggccagacgctcggattcggcatagagctgacagggatcgctgacaaaatggcactgaccgccgtagaaggtaatttgctcaattttccgctttgcagtgctggctggcatcacggcaataaagggtaagcccaacaggcgagcaaaataggcttcagagacggcggtactgccagaagaggcttcaataacaggcgtgccttgtttgatccaaccattggcaagcgcataaagaaacagggaacgcgccaggcgatgtttcaggcttccgctgggatgcgtactttcatctttcagatagaacccaatgcccggaaaatccggcaaactgaagcgaattaagtgcgtgtccgctgagcgttgaaagtcagcgtttatttcgttaatcgcgtggcgtatccagcatgttgacatagggttcatttccgctcgggtgaaagtcactatcttaaggcacgtgcaggaaaaagagcttgcaggttttgcgttaaaatggcggtaatggagaaaataattctaccggaggcccatatgccagataaaattgaccttaaattgctggctatgttgcagcaggactgcactacctcgctccaggtgctggcggacgcggtgaatctcactaccacgccctgctggaagcgcctgaaaaagctggaagaagatggcattattcgcgggcgggttgcactgctggacaatgaaaaacttggcctttccctgacggcgtttatgtttgtcaaaaccacccagcacagtaaagcctggtatcaggagttcgtctcggtggtgcagagcatgccggaagtgatgggcttttaccgtatggccggtgagtacgattatttactgcgtattcaggttgccgacatgaaaagttatgatgccttttataagcgtttagttaatggtgtaacaggcctgatcgatgtgacctccagctttgcgatggaagagattaaatacacgacagccctgcctgttggcccttgagtaccagagattgagagcagccttgtgcgattattcagccagttaagttggtattttattcgtgagtggcgacgctaccttggcgccgtgaccttactgatcgttattgccgtactgcaattactgccgccctgggttgtgggcgtgattgttgacggtgtcacccatcagaacatgagcgcccgccacataatgatgtggattggcattatgttgctgacggccgtggtggtttatctgctgcgctatgtctggcgcgtgctgttatttggggcatcctaccagctggccgttgagctgcgcgaagatttttatcgtcagctcagccgtcagcagccagccttttatttgcgtcaccgcaccggcgatcttattgcccgcgccaccaacgatgtcgatcgtgtggtctttgccgccggtgaaggcgtgctgacgctggtggattccctggtgatgggatgcgtggtgttgattgccatgagtacccaaatcagctggcagttgacgctggtgtcgctgatacccatgccatttatggcgctggtcattcaccgctatggcgagcagttgcataaccgtttcaaactggcgcaggcagccttttccagtctgaacgaccagacgcaagagagcctgaccagtatccgaatgatcaaggcgtttggcctggagcagcatcagtcagagcagtttgccgatattgcccgcgacaccggcgagaaaaacctgcgtgttgcgcgggtagacgcgcgttttgatcccaccatttatatcgcgattggctttgccaacctgctggcgattggcggtggaagctggctggtgtggcatgagcaaatgacgctcgggcagctcaccagctttgtgatgtatcttggtttgatgatctggccgatgctggcgctggcatggatgttcaacattgttgagcgtggcagtgctgcctggagccggattcgtgcgttactctctgaggcaccggtggttgaagacggcgataaaacgttgcccgagcgggcagggacgctgcaggttgccattcgtgagtttcgctatcccgccagctcgggcgcgatcctgagccacgttgagtttcagcttaagcctggcgatatgctgggcctgtgtggcccgaccggcagtggtaaaaccaccttgctgagtttgattcagcgccacttcgatattcagcaaggggatattcgctatcatgcgattccgctgccgcaactgcgtctggacagctggcgcagccgcctggcggtggtcagccagacgccgtttttgttttccgacagcgtggccaataacatcgcgctgggcaagcccgatgcccgtcaggaggatatcgagcaggcggcaaaaatggcctgcgtccatgacgatatcttacgcctgccgcaagggtatgaaaccgaagtcggggagcgcggtgtcatgctgtcgggcggccaaaagcagcgtatctcaatcgcgcgtgccctgctgctcaatgcagagatcctggttctggacgatgcactgtcggcggttgacgggcgcaccgagcatgacattctgcataatctgcgccagtgggggaaaggaaaaacgttgatcattagcgcccatcgcttatccgcactgactgaagccagtgagattctggtgttacatcagggaaccgtagcgcaacgcggcgaccatgccgccctgagcaacaacgcgggctggtatcgggatatgtaccgctatcagcaactggaagccgcgctggatgatgatgaaactgaaaaaggagcgccacatgactaagtcacaaccgatgtggccaacactcaaacgcctgctgagttacggtaaaccctggcgcaaatccctgtcgctggcggtgttaatgctgtgggtggccgccgccgccgaagtcaccggccccgtattggtaagttatttcatcgataatctggtggcgaagcatcacatgccctggggcattgtggcgggcctggtggtaagttttattctgttgcaactgctggccgctgcgctgcattacggccaggcgctgctgtttaaccaagccgctattggcgtggtgcagcgtttacgcaccgatgccatggacgcggctctgcgtcagccccttgccgcgtttgatacccagccggttggacaactgatttcccgggtgaccaacgacaccgaagtcgtcagggatctgtatgtgaccgttgtggcaaccgttctgcgcagtgcggcactggtgggcgcaatgatggtggccatgttcagtctggactggcgcatggcgctggtggctatgttgattttccctatggtgcttatcgtgatgctgatttatcagcgcttcagcacgccgatagcccggcgcgttcgcagctatctggccgatatcaataacggctttaacgaagtgatcagtgggatgagcgtgatacagcagtttcgccagcaggcgcgctttggcgaacgcatgggtgaggccagccgctctcattatctggcgcgcatgcaaacgctgcggcttgatggtttcctgctgcggccactcttaagcctgttttcagcactggtgctgtgtggcttactgctgttattcagtttttcgatgccgggtgttttcgaagtcggcgtactgtacgcatttatcacctatctgggacggcttaacgagccgctgatcgaactcacgacgcagcagtccatgttgcagcaggcggtcgtggcgggcgaacgtatttttgaactgatggatgcaccgcaacagcattatggtgacagtgaccagccgatgacgtccgggcggattacgctgaataacctcagttttgcctatcgcgataatcgcgacgtgctgagcaatattagtctggatgtcccctcacgcggttttgttgccctggtcggtcataccggtagcggtaaaagcacgctggcaaacctgttaatgggttactacccggtgacgcgcggccaggtcaggcttgacgatcgcccgctgggcgagtattcccaccacgcgctacgacgcgatatcgctatggtgcagcaggacccggtggtgctggccgattcgctgctggccaacgtgcgtctgggccgggatatcagtgaagacgcggtgtggacagcgttggagcaggtgcaactggcaccgctggcccgcgccttgcccgacggcattcacacccgactgggcgagcaggggaataacctgtccgtggggcaaaagcagttactggcgctggcgcgtgtgctggtgcagttgccgaagattctgattcttgatgaagccactgccaatatcgactccggcacagagcaggcgattcagcatactctgcgcaccctgcgccagcatacgacgctggtggtgatcgctcatcgcctctcgaccatcaccgaagccgacaacattctggtgctgcaccgcggtaacgtggtggagcaggggacgcatcagcaactcctggcattacaggggcgctattggcaaatgtaccagctgcaacaggcaggtgaggagctggaactggccgcgccgttagtcagcgcagtctgattgcaccttttttgcacatattttctcccttgatccgtttggatgcacgtctttgagcctgagcgcaccaaagatgtgcatccgcttcgcttatctgtccttcttacctttcctgtccacatattcagcattaactgagccttattccgtcgcggcctgataactgatttcatcctttaattacatctggcacaggctttgcttaagtctctgcgtgtccatgagacttacttatttcaaacccttaaggagaggctatgaagctggttaccgtcgtaattaagccgttcaagcttgaagatgtgcgagaggcattatcctcaattggtattcagggactgaccgtctccgaagtgaaaggttttgggcgtcagaaagggcacgccgaactgtaccgtggggcggaatacagcgtgaactttctgcctaaagtaaaaattgatatcgccattgccgatgaccaactggacgaagtggtggacgtaatcagtaaatcggcttacaccggaaaaattggcgacggtaagattttcgttgctgaactgcagcgcgtgattcgcatacgtaccggcgaaaccgacgaagccgcactgtaaacaagactcagtaatgtgatgggatggaaaaaaatgaataaaatgctgaccaagttgggcctcaccagcctggcactgttaccgtcgctggcaatggctgctgcacctgccgttgcagacaaagccgataacgcctttatgatgatttgcaccgcgctggtgctgtttatgtcaattcctgggattgcgctgttttacggtggcctgatccgcggtaaaaacgtcctttctatgctgacccaggtggctgtgaccttttcgctggtgtgcgtgctgtgggtcatttatggctactcactggctttcagtgaaggtaacgccttctttggtagctttaactgggtgatgctgaaaaacattgctctgacagcggtgatgggcagcttttatcaatatatccacgtggcattccaggcctcgtttgcctgtattaccgtagggctggttgtcggtgctattgctgaacgtattcgcttctccgcggtactgatttttgtcctggtgtggctcacgctggcctatgtgcctatcgcacatatggtatgggcgggcggtttgctggctcaggatggcgcactggactttgcaggcggcacggtggtgcacattaacgctgcggttgcaggcctggtcggtgcttacctggtgggtaaacgtgccggttttggtaaagaggcgtttaaaccgcataacttgccgatggtgttcaccggtacggcgattctgtatgtcggctggtttggttttaacgcagggtcggcgtctgccgctaacgaaattgctgcactggccttcctgaataccgttgttgcaactgcgggtgccgtgctggcatggacctttggtgagtgggcgatgcgcggcaaaccttcgctgttaggtgcctgttctggcttcattgctggcctggtcgccatcactccagcctgtgggtatgtcggtgtcggtggcgcgttaattatcggtttagtgggtggtctggctggcatctggggcgtgacaacgctgaaaagatggctgcgggttgacgatccttgcgacgtattcggtgttcacggcgtctgtggcatcatcggttgtatcctgacaggtgtattcgcgtcttcctcgctgggcggcgtaggttatgccccaggcgtcaccatgggtcatcaggtttcgattcagttgctgagcgtgggtgtcaccattgtctggtccggtgtggtggccttcattggcttcaaactggcggatatgattgtgggtctgcgtgtaccagaagagcatgagcgcgaaggcctggacgtcaacagccatggcgagaacgcttacaaccaataagttatctctacagcgataccgataaaacaaaggggcgatttcgccccttttgctattcgtgacgctggcgcatcaccccttcctgcaccgttgacgccaccagctcgccttgccggttataaaattcgccacgtacaaagccacgcgcacctgacgcggaagtactctccacgctatacaatagccagtcattgaagttcagcgaacgatgaaaccacatagagtgatctatcgtcgctacctgcatatcggcttccagaaaacctttaccatgtggctgtagcgccaccggtaaaaagttgagatcggaggcatagcccagcagatactgatggatgcgcaaatcgtctggcagcgttccgttggcccgaatccatacctgacgctgtggtttatcaacatgacctctcagcgggttgtggatctgcaccgggcgaatttccagcggccgttcggcaataaatttttcacgcagtttttctggcagcatatgggccattttttgcgccatctgctgttcattaggtaagttatcgggcccttttacctgcggcatcggcttttgatgttcaaacccgctctccggtgcctggaaggaggccgtcatataaaaaatcggctggccgttttgaatggcgctaacccgacgggcgctaaagcttttaccatcgcgcaggctttccacatcgtaaataatgggcttctggctgtcgccagggcggagaaaatagctgtggaaggaatggataatgcgatcgtcggggacagtctgtttggccgcaaagagtgcctgtcccacgacctgaccaccaaagacctgacgcagtcccagatcttcgctctggccgcgaaacagaccttcttcgattttttccagatggattaaagtaagcaaattttcgagtgcctgactcatggcgctttcctgattatcagtatttacctcagtgtgaaagatccgaccagtttccgtcaatcagactttctgtctttcatccaaccaggcaaacttctgattttgtgccaacattaaggcatacggcgagtgaaacgctgtaatgaagattcactgctaaaaatcattttgatcaaaaggagacgacatcaatgaaattctggcatgtgttaagtggcgtagcgatggcaatggctctcgcaggttgtgcacacaaaggcaaaccggtgccaaccccgaccttgggttcggcggttgcaggacaaacagcaacgattgctcagcctaatgtcagcggatcggtctatatccgccagcgtatcgcgcttccaccgaatgcggcgctgaccgtgacgctgtccgatgcgtcggtgtctgacgcaccgtcaaaagtgctggcacagcgcgtcgtacgtacggatgggaaacaggcaccgttccactttgtgctgcctttcaacccagcggatattcagccaaatgcacgtatcctgttgagcgccgcgattaccgttgacggcaaaatggcctttattactgaagaggttaaaccggtcattaatcagggcggaacgaaagccgatctggtgttagtgccggtaccatcaatggcgatggcgacacaacctggtgcagcgaccagcgtgccgtccacctcaccgactcaggttaccccgtcagccgccgtgcctgcgccgacgaccatgtaatgccttagggcgatatgttcagggcgacctcgttgtcgccctgatgcattaaaaccgccaacgatatttttctaaatcaatctcaccgccgtcactcacttcaacgccttctgcttccagcgcgtctcgctgacggaataaacggtcaccctgcaacgaaatcgtgccatgacggttaatcacccgatgccagggaagcgtgctgccctcgggtaagcgactgagtacgccaccgacctgacgtgctgctctgggcgagccggccaacaatgcgacgtcaccataggtggtgactttaccgggtggaatcgcggcgacgatttgccagattcgctgtttaaagctgtcagtgctgtccatcggcgtaccctgcccaaaaaaagacgatgattttatcacaatgcaggttaattatcggcgatcgtacaagaaaccaacggtcatccccaccaggcttgcaattgccgggggcttccccgataatgcctccgctctcgaaatgagggctagtcaatggaggccctgttggttctcccgcaatgctagcttgtgaactcggtcaggtccggaaggaagcagccgcagcaggtgacgtgtgtgccgggatgtagctggcagggcctccaccatttcatctctgtcacatccctttcttcaaatgataaacagccgaagctcgcctgggccgttccattgccggcaggcgagttatgcagatactggctggtgaaatcagattaaacgtaaagcaaaaataacttagcgtacaaatttccagactgagaccggtactttgtcataaagcttgttcatggtcagttccgccagacgatggtcggctgctgagtagaatactgctaattcgtcatcgggtaattcgtacttatttttttcaatcactctttccagcgtgtcaattgaacgacagcgcctcagtcgcatcaaataatcagttttagttagggttttgttcataaataaaccgttctcacgtcagtactataatgaatggcttggctgttgaagaaaagcgcactcttcagtaaacagattaaataaacgtttcgctgagcgttgccagcgctgaaggtcctgagtgtttacactatagttgctgaacagcataaaggtatcatcaagatattcatcgatttgggtaatcagtgcttcgtcttcaacatgcttaattttgtaattcatggtgaaagaggcgatatgctcaatcagatcgtttagctgtaaattgctttcggcagtaggatcattaacccagccatgatgactgtcagttaatgtcgccatgcttgcgtcaaacaaactctcacacaagtatttaagctgggcaatatcatgccgtttcggtgagtattcgtccatctttttcccctccgtagcaagcaaagttaccgcaatgcggcaagattaggtgaagtggcaaagaagtggttgtcgggtttgtaaataacggactgagttaagaatagtgtaaaatcattagttctgctcacctccattactaaatattacaattcatcgccaggtgaggggcgctgattctcgatcggctcaaacacaagcgcagcagggctgatatgaaagctgacttgttcattctgcgtaatggtttcatttaaatccaggcagggattaaatacattccactgaaaatcgtaaagtaacttaaatctattcgaccccgtcatctcaacagcaataacttttaaactgtctggcactaacatggcattagctgaataccattgtaaatcgccaaccagagaatctgttattttgagaatattccgcccaataattgtggctaattttgcgcaatccgtttcatcctgcgcgacattgcattcaattcttactgacatggcctgctcataaataacgcctgtaaacccatcattgatgttcttctggcggtttgcaagtagcagtgcgcctgtaataagagattagtagtgccagttttaagcaagtgattgattcgttactgcttatcaaacgtggctttacaggcaatttgtgcgctgatttattttttgaaacacattgctgtgcctctggcaccacaacatcggatatcatggttgttatgttataacatttttcctggtgcagtgatgaatcaaagtgggctgttaatgtcactcggtgggcggttagtcgtagcactcatgttaatcgctgttctggcaatagcgatgtggtggggaatgcagccgtgatagcgttcagaaatttgcaggtgggttatcaggggcaatcggtgacgcccgttgtgacgacggagctggctcagggcagcatgaccgctctgatgggagcgaacgggagcggaaaatccacgctgattaaaaccattgccggcttattgccgccggtgaaaggacagtgtgagctgcatgtcccacgtcgcgaagtcgggtggctacctcagcgcagtgagctggaaacacgtttcccgctgaccgtctatgaactggtttcgataggctgctggccgcgctgtggatggtttggtggtatcaaccgggcattacgcaaagagatcagcgacgcgctggatgcggtgcagatgagcgactatgccgatgctcaaccttccaccttatctggtgggcagctgcagcgcgtgctgtttgcccggctcatgctgcaacgcagtcgcctgtggttgcttgatgaaccctttaacggcatagacagcaagacggtgacgttgctgatgtctgttttgcagcagcagcagcaggccggtaccacgctcatggtggtgctgcatgaccatcccctggtggagcgctacttcacggatgttctgtctatggatgatggttctcatcgacgtagcatggtcgataccgctccgttacggagcgtcgcgccgtgacaattattcaacctttcattgagttcagctttatgcgacgggcgctggtggcctgtgtcgcgctggcgttcagtgccacgccgctgggcgttttcctgtctctgcgccggatgagcttaatcggggatgctttatcccatgccgtgctgcccggtgccgccatcggctatttaatctcgggtttgtccctggtggcgatgggcgttggcggactgattgcaggcctggcggtggcgctgctgtcgggggccgtcagtcgttatacgccacttaaagaagatgccagctttgccggattttacctcggctcgctggcgctgggcgtcacgctggtttcactgcgtggctccagcgtcgatctgctgcacgttctgtttggatcgctgctggcggtggataatcctgcactggcggtggtcggcggtatcgccgcgtttacgctgctaatgctggccgtcatctaccgtcctctggtcattgatgcattcgattcagattttctgcgcgcgcagggcaaatggagtgcgccgctggtgcacggtattttcctgacgctggtggtgcttaacctggtcgcgggttttcaggtgctgggcacattaatgtcggtcgggctgatgatgttgcccgccgccagcgcacgcttctggagtcgtcaccttgtcgtcatgctgggctcagccatgttgatggccgtgctgtctgcgtttgcggggctggtactttcctggcacttttcactgccggcaggcccggcggtggtattaagtgccgcgatgctgttttttctctccatcttaacagggccgtgcggtggcattctgcgccgccattaatcagaggtagctatgaagatattacccattagtctggcaattggggcgttagtcatcagtccattatcaatggcaaaaacggtagatgcggtagccagttttaccgtgctggccgatatcgtgaaacaaattgggggcgatcacgttcacgtaaaaagcctggtagggccgaatggtgatccccacacgtttgaacccacgccacaagacagcgaagcactggcaaaagccgacgttgtctttgtcagtggtttggggctggaaggctggatgaatcgtctggtgagtgcgtcgggctataaagggcaacctgttgtggcctcgacgggcattgaaacacggacgatggaagaggatggcaaaaccatcaccgatccccatgcgtggaacagcatgtataacggcacgatttatgccaaaaacgtgatggatgcgttgattaaggctgacccgcaggatgctgatgatatccgtaagcgcggcgaaaattatattcagcagctacagaaactggacagctgggccaaaacgtctttcgcggcaattccacaacaaaaacgtaaagtgctgaccagtcatgatgcttttgggtacttcgggcaacgctatggcgttaccttcctggcacctgtcggtttctcaacggaagcggaagccagcgccagcgatgtggccagcctgatcacccagcttaagcagcaacatattaaaacctactttatggaaaaccagaccgatcctcgcctggtgaaacagattgccagcgccaccggtgctaaacctgggggtgagctgtatcctgaagcgctgtcaacggcttccggccctgcgcccacctatgaagcggcgtttaaacacaatgttgaggtcatgctcaaaagcatgccctgagcataaaaaaagccggaatggcgggtgagcgacattccggctaaggttcacgacacatcaacgttttttctttcttccctgcacggctttaaagcgcggattcgttttgcagatgacatagatgcggcctttacggcgtaccactttacaatcccgatgccggttcttggcggaacgcagcgaactcaatacctgcatgatgtcctctcttatcgacggcccagaaaacggctgaagcgctggttaaagcgcgcggtactgccttctttagcaaagtctttctgtttaccggtataaaacacatgggatgccgacgagacgtcgagtgtaatgtaaggcagggtttcgccttcaaactcaacggtgcggtcagtcttaatggttgaaccgattttgaaatacacgtcagcagaggtgtcatggaacaccacggcacgatacgagggatgaatacctgctttcataattgtcaccaatgtaatgttataatataacaatattatgcgctgcacctgatccgaatgcaaccctcgaaaaaccaggggcaaacagcgtcgaggcagggagaaaaccgcatgcaggtgacaagccaacgcaagcaaaccgaaaagcgtaaaggcaggttgataccggcgatgttccgacgaaggtcagaggcgcaagctaaagcacgtgaaggctggcagagatcaatctgtggcgagggaagtcagcgtggcggtaaacagtgaagggattaaaaaaggccgctgacgcggcctttatgtttacagattaatgcgtgtggttatcgacaggatgatccttttcgatgtccgctttgttcttaccgaagcgacggcgcaccacaacaaagaataccggtacaaagaagatagccagcgcggtagcggtaaccataccgcccattacgccggtaccgaccgcattctgcgcacctgaacctgcaccggtgctgatggccagaggcagtacgccaagaataaaggccagcgaggtcatcaggataggacgcagacgcatacgacaggcttcaagcgtcgcttccaccagacccttaccttctttctccatcagatccttcgcgaattccacgatcaggatggcgttcttcgccgagaggccaacggttgtcagtaaccccacgacaaagtaaacgtcattactcaggccacgtaaggtggtgaagagtaacgcaccgaccacgccaagcggcacgaccagcatgacggagaacggaattgaccagctctcatagagtgcggcaagacacaggaataccacaatcagcgaaatggcatacagagccggtgcctggttgcctgacagacgttcctgataggacattcccgtccagtcataaccgatgccagttggcagcttagaggccagctcttccatcatgttcatggcttcacctgaactcttgcccggtgtaggctgacccagaatttccatggctggcaaaccgttatagcgttccagacgcggtgaaccatactgccagtgagcggaggagaaggcagagaagggcaccatctcgccgttgctgttacggacgaaccacttattaatgtcgtccggcagcatacgtgcgtcggctttacccatcacgtagaccttcttcacacgaccacggtcaataaagtcattgacgtaagagccgccccaggatgcgccgagcgtggtgttaatgtcactgagtgacacgcccaatgcctgcgctttctcctggtcaatatccagtttgaactgcggggtatcttccagaccatttggacggacaccgaccaacgtatccggatgctgggcaatcatgcctaacagctggttacgcgcctgcgtcagtttttcatgaccaaggtttgcctgatcgattagctcaaagtcaaagcccgtggcgttacctaattcaataatcgctggcaggttaaacgcaaacaccataccgtctttgatttggccgagagcctgcatggcacgtccctggatagccggaactttcatgttgctgctggtacgctcatcccagggcttcaggctgacaaaggcgataccggtgttctgtccacgacccgcaaaaccaaacccggcaacggtaaagaccgatttcaccgagtccttttcttttgtcaggaagtagtcagaaacctgatccagtaccttctgcgtacgttcctgggtcgcacccgcagggagctgtgcctgagccagtaacaggccctgatcttcttccggcaggaaggaggagggcaggcgcaggaacagaaacgccattcccaccacaatcagcaggtaaagcagcagataacgaccggtgccgcgaacgatatggcccacgctatcgacatagtgatgcgtgctcttgtcgaatagacggttaaaccaaccaaagaaaccggtggttttaccatggtcgccttttttcaccggtttgagcatggtggcgcacagtgccggcgtcagaatcaatgcgaccagcaccgacagcgccatcgcggacacaatggtgatagagaactgacggtaaatgacaccggttgagccaccaaagaaggccatcggaataaataccgctgacagcaccagggcaataccgaccagcgcgccctgaatctgtcccatcgaccgcttcgtggcttctttgggtggtagcccttcctccaccatgacgcgctcgacgttctcgaccaccacgatggcatcatccaccagcaagccgatggcaagcaccatcccgaacatcgtcagggtatttatcgagtagccaaaggcgctgataatcgcaaaggtacccagcaatacaacagggacggcaattgtcggaatcagtgtggcacggaagttttgcaggaacagatacatcaccaggaacactaacagaatggcttccatcagcgtcttcaccacttcgaaaatagagatttttacgaaaggtgtggtgtcataaggataaacaaccttcatgcctgccgggaacgtgggctgcagttttgccagctccgccttcaccgcatctgccgtattaagggcattcgcgccggtggccagtttgataccaataccggaagccggtttgccattataacgcgcgatgatctcgtagttttcaccccccagttcaatctgcgccacatcgcgcaggcggacctgagaaccatcactgttcactttcagtaaaatgttgccgaactctttggtggaggtcagacgggtttgcgcaatgatggaggcgtttaactgctgtcccggtactggtggcgtgccgcctaactgaccggcagccacctgggcattctgagttttcagcgcattaataacgtcaaaaggggttaactggtagttattaagcttgttggggtccatccagatacgcatcgcatactgcgcaccaaatacctgagtgtcacctacgccaggcgtacggctgataggatctttgatattggaggccacatagtcagaaatatcgttctgcgtcatgctgccgtcatcgctgataaaaccggcgaccatcaggaagctactggaggattttttaacctgaatcccctgttgttgcacttcctgaggcagcaacggcatggccagctgcagtttgttctgcacctggacctgggcgatgtctgcatcggtacctgactcaaacgaaatcgtcagcgtcagtgcacctgatgagtcactgcttgatgacatatacatcaggccatcaataccattcatattttgttcgatgacctgcgtcaccgagtcttgcagcgttttggcgtcagcaccggggtagttggcctgaatctcaattgccggtggcgcaacattgggatattgctcaatcggtaatttgagaatcgataacgcgcccgctagcatcacgataatagcaaggacccacgcaaagatggggcgatcgataaagaacttagccatgtatcaacggctcctgttatgacgatgttttagcagactgcgctttggacggatcaccgctcgcggctttggcatcatctgtggcttctttaggcgtaacctgtgcacccggtttcgcgcgctgcagaccggtaaagatcacgcgctcgcccgctttaagcccttcggtgaccagccatttgtccccaatagcctgggcagctttgatcttacgcgcttcaaccttgttatccgcacccacgaccatcacggacgcatcgcccgttggcgtgcggctaaccgcctgctgtggcactaacaaggcattcggattggtgccttcatccagacgggcacgcacaaacatgcctggcaggagtgatttgtcaggattcgggaaaatggcgcgcagggtaattgagccagtggtttgatcaacggtgacgtcagaaaactccagcgtaccgggctgagaatagtccttgccgttctgcatcagcagggtgaccttcgctttaccgtcgttctgcttaagctgacccgattccagttccgagcgtaaccgcaggaaatcttcactggactgggtaacatcgacatacatcggatcaagctgctgtacggtcgccagcgccgtagtctgtccactttgcaccagtgcgccctctgtaacggaagacttaccgatacggccgctgattggcgaggtcactttggtgtaagcaagattgatgcgtgctgtttccacattggctttggctgactgaaccgcagcattgttctgcgcggcggtagcgacagccgtatcgtaatcctgctggctgatatatttagtgccaagcagcggcttgtagcgattcaccgtaagctgagcaatgcgcgcattcgcttctgccttggctaaatcggcttttgcactgtcataggacgcctgataggtagcgggatcgatctgatacagcgattcaccggctttaatctcaccgccttcaataaagttacgcttcagaataataccggaaacctgcgggcggacttcagcgatgcgataagcagacgtgcggccaggcagttcagtagaaatgtttaacggttcgcttttaaccgtaacaacacccacttctggcggctgttgctgttgagcggcctggtcggatttatttccgtcacatcctgttaacacaaagctgcctgatagcatcaggacggccgccagaggcgttaaccctctgaatttagtcataaataaacctctagagtccgatatcaaatgatcaatggatcacaaagccaggaacccattgctgcgtaagagtgtaggtcgtgctatggtacatacattcacaaatgtatgtaaacttactcgattgtaaaaaaagtcccctatggcacgaaaaaccaaagcgcaagcacttgaaacccggcatcaaattcttgacgctgcacttgccctgttttcaaaagagggggtttcagccacttccctggcggatatcgcatccgcagccagcgtaacccggggagcaatctactggcatttcaaaaacaaagccgacctgttgaacgaaatatggcttcgcagtgatgcagggctggatgacgtgaaacttgagtatcaaacaaaataccccggtgatccactctccattttgcgggcgatgctcgtgtatgtcttccaggcaaccgccagagatccacagcgccgggcgttgatggaaatcatcttccacaaatgcgagtttgtgggtgaaatggcggcgttaaaaagcattcagcaaagcctgttactggagctctacaatgagattgaagatgttctgcgccagtgcattgatgccggacaactcccagaaactttccagacacgtcaggctgcattgattatgcgcagctatgtgaatggcatgatggagagctggctgtttacgcccgataaatttgatctggttgccgatgcgcctgagctggttgatgcgctgattgatatgctgcgcttaagtccgacgctggcaaaaaaagcttaatctttacgctgcgcgtcacgcttcctttcataatcgcgctgaacaatggctaatgcagacagcacggtttctacagcgagctgattttcttcaaaaagctgaattaaatccactgccagcttgacctcttcaggtgccgtatccagggacatctttcctccagagcagttgtatcatgggccagataagcgtgccatctgggaataccgtccagcaaagatagcgcattaactgctaaaggggctgtttgataacgacatcgcccattccactgaacgaatagcctgtttacagcgtgccatccgaccttccagcacctccaggtctttcttcaactgctgctggaccgccagcgtttctgcctgcgccattcgctgttcacgctgatcaatcatctcctgcagtcgacgcgcatattcgcagtattcctgatattttaactgccgcgatgagggctgaacgcgttcctgtcggctgcgcaactgctgtgtgctggcttcgcgttgtagcgcggcaatctgatccaccaaatggcttgccagccactggctgcgatcgacatcaccgctgtgctggcaaaggcgctggtaattttgttctatctcctgcaaataatccgccagccgggtgcctttagtggtaaagagctggctgtcaaagcggggtgaacggcagcgcccatctggctggcgcgcgatatcctggcgcagggccacaatacagttaagcagtcgttgtgatgccgtggcgttactcatcgcccggcactcaggtatgctaaggttatgggactggaaacgcgctgagcgacctttatgcaacgcattgtgttattaacccttggctggctggcgattgtgcttggcatactgggcattgtattacctttattacctaccacgccatttatgctgttggcggcatggtgttttgcgcgttcttctccccgttttcatcactggctgctctggtcatccccttttggccgttatatccggcactggcaacaacaccgtggcatgccgcctggtgcaaaaagccgggcgatgctactgattgtggtgacctttgcggtttcgctctggctggtgccgctgtggtgggtacgtatcatgctacttattatgttgtgtctgctattgctgtttatgtggcgtattccggtggtggcagaaacagcggatgaacccttaccaccgcgataaagttgcaattagctggccatttgcttagatttgggcctcttcgtgcgtagcttcccattattgatgtatctccgctgagcctttaccccggtattggcgctattgaagctgcgcaaaacagaacagaatttttttaccaggcttaagattatgaccgacactgcgcagcagcttgaactgattaaaaacagtatcaaaagtattcctgattacccgaagccgggtattcttttccgtgacgtcaccagcctgttggaagatcctgtcgcctatgcggcgtctatctcactgctggtggaacggtaccgtaataaaggcatcaccaaagtagtcggcacggaagcgcgcggtttcctgttcggggcaccggttgctttggggctggaactgggttttgtaccggtacgcaagccgggcaaactgccacgtgaaacctacagcgaagcttacgagctggagtacggcaccgatcggctggaattgcacaaagatgctatccagccaggcgatgtggtgctggtggtcgacgaccttctcgccaccggcggaacgctcgaagcgaccatcaaactgattcgtcgtgccggcggtgaagttaaagatgcggcatttattatcaacctgttcgatctggcaggtgaagcacgtctcaaggcgctgggcgttgacagctacagcctggtcaatttccccggccactaagcctcgcttatggcctcacaatctgctgaggccgttcatctttccctgttcaagataacgagtgataggtgaaagcgtagctggtagactactgcaatcatatacaggggttgcagtgcgtctgcgctcacatttccatccaaattcgtcgaaaccacatgagctatcaggtacttgcccgaaaatggcgtccacaggcgtttgctgatgttgtcggtcaggaacacgttctgacggcgctggcgaatggattgtctctgggacgcatccatcatgcttatctcttctccggcacgcggggcgtagggaaaacgaccattgcccgtctgctggcgaaaggccttaactgcgaaacgggcattaccgccacgccgtgcggccagtgcgataactgtcgcgagattgagcaggggcgttttgtcgatttaattgaaattgatgccgcctcgcgcaccaaagttgaagacacgcgcgatctgctcgacaacgtgcagtacgcgccggcgcgtggccgcttcaaggtctacctgatcgatgaagtgcacatgctgtcgcgccacagctttaatgcgctgctgaaaaccctggaagaaccaccttcacacgttaagtttttgctggcgaccaccgatccccagaagctgccggtgacgattctgtcgcgctgtctccagtttcatctcaaagcgctcgacgtcgatcagattcgccagcagttggatcgtgttttagagcaggagcagatttcgcgtgagccgcgtgccctgcaactgcttgccagagccgccgatggcagtatgcgtgatgcgttaagcctcaccgatcaggcgattgcgatgggcgagggcagcgtgaccagcgccaccgtgggtacgatgctgggtacgcttgacgatgaacagccgctgggtctgcttgaagcggtggtcgaaggcaacggagagcacatgatggcgctgttggcccaggcggcatcacgcggcgttgagtgggaagcattgttggttgagatgctgcgcctgctgcaccgcattgctatggtgcagctactgcctgcgtcgctcaatgacgacgaagagagtaatgcgctgcgcctgcgtgaactggcgcgcgccgtgccaccggccgatcttcaattgtattaccaaaccctgcttatggggcgcaaagatttaccactcgcgcccgatcggcgcatgggcatcgagatgacgctgttgcgtgcactggcgtttcatcctaaggcggcaatcgccgaaccggttgcgcgtcctacgctgaccgcgcagtctgccccggcaccagtgcagactgtggcggctcaacctacagagaaaacgcccgccgcgcagccgcaaatggcagcaccggaaccggctgtcactcagcaggctgtgccgcctgcgtcgcccgatccctcactatccagttccaccagccagctcctgcaggcgcgcacccagttgctgcgccagggagcaaacaaagcaaaaaagagtgagccggcagcgccaggtgcgcggccggccaactccgcgctggaacgactggcctctgttaccgaacgtagccagcagcgcgtgcgggacagcgcgcctgcggcaccggtaaaaaaagaggcataccgctggaaagcgcaaacgccggtgaccgaggtcgtcgtcgagccggtcgcgacgccaaaagccttgcgttctgcgctagagcatgagaaaaatcctgagctggccgcgcggttggcggaggaagcccagcagcgagatgaatgggcggcagaagtcgcaggtttaccgctgcctaagctggttcagcaactggcactgaatgcatggaaagaaaccacggataacggcatttgcctgcatttacgttccagccagcgccacctgaattctgcgtcggcgcagcaggccctgagcgccgcattgagtcaggcagcagggcatcaggttgaactgtcggtaattgaagacgataattctacggtattgacgccactggagtggcgtcaggccatttatgaagagaagctggcgcaggcgcgtcagtcaatcttgagtgacacccacattcaaacccttcgtcgcttttttgatgccgatttggatgaggaaagcattcgacccgtttgaacacgctgcaacggtctgaataaaccgcgttgtagcctcagcagagagagaaaactatgtttggtaaaggcggattgggcaacctgatgaaacaggcccagcagatgcaagacaaaatggcccaggttcaggaagaaattgccgccctggaagtcacgggtgaatcaggtgctggcatggttaaggtcacgatcaacggtgcccataactgccgccgggtagaagtcgatccgagcctgcttgaggacgacaaagatatgctggaagacctgattgccgccgcgttcaacgacgccgctcgccgcattgatgaagtgcagaaagagaaaatggcctctgtctcttcaggtatgcagctgccaccaggcttcaagatgccgttctgatgcaaaccagcccactgctagagtcattaatggagtcattgcgctgtttacccggcgttgggcctaagtcggcacaacgcatggcgtttcaactgctacagcgcgatcggagtggcggaatgcggctggcgcaggcactgacccgggccatgtcggaaatcggccactgtgccgattgccgcaccttcaccgagcaggaaatctgtaccatttgcgccaatccacggcgtcagcaaaatggtcaaatctgcgtggtggaaagtccggccgacatccatgctattgagcaaaccgggcaatttgccggccgttatttcgtgttaatgggccatctttcgccgcttgacggcattggtccgggcgatatcggtcttgaccgactggaacaacggctggaaaaagaaacgcttcatgaagtgattctggccaccaatcctaccgtggaaggcgaagccaccgcgaactacatcgctgaattgtgcggtcagtatggcgttgatgccacccgtattgcgcatggggttccgatgggcggtgagctggaaatggtggatggcaccacgctgtcccactcgctggccggtcggcaaaagattaaattttaaacgcttgccggtgttgtgaaagacaccggcttgaaaacctctcatttatccccacatcctcctcaacgttcgttaaatctgattctgttgaggtagcaatgaccatgaaaggacaagagactcgtggctttcagtcagaggtaaaacaacttctgcacctgatgatccattctctctattcaaacaaagagattttcctgcgtgagctgatttccaatgcttcggatgcggcagataaactgcgcttccgcgcgctgtctgatgccagcctgtatgaaggcgatggcgacctgcgtgtgcgtctctctgtggataaggacaaccggaccattacgctcagcgataacggtatcggcatgcgtcgtgatgaagtgattgaaaacctgggaaccattgctaagtcaggcaccaaatccttcctggaatctctgggttcagaccaggcaaaagacagccaactgattggtcagtttggtgtgggtttctactctgcatttatcgtcgcagataaagtctctgtgcgcacccgtgcggcgggcgcggcagaagacgaagccgttttctgggaatcggctggcgaaggggattacaccattgccgatatcagcaaagccgagcgcggtactgaaattaccctgcacctgcgcgaaggcgaagatgagttcctcgacagctggcgcgtccgcaatattattggaaaatactccgatcacatcgccctgccggtagaaatcgaaagcaaagatgaagaaaccggcaccaccacctgggagaaaatcaataaagcccaggcactgtggacccgcaacaaatcagaaatcagcgatgaagagtacaacgagttttataaacacatcgcccacgatttcagcgacccggctatctggagccacaaccgcgtagaaggtaaacaggagtacaccagcctgctttacatcccggcccgcgcgccctttgacatgtggaaccgcgatcataaacacggcctgaagctttacgtgcagcgcgtgtttatcatggatgacgctgagcagtttatgccgaattacctgcgcttcgtgcgtggcctgattgactcaaacgatctgccgcttaacgtatcgcgtgaaatcctgcaggacagccgcgtaacccagagcctgcgtggcgcgctgaccaaacgtgttcttcagatgctggataaactggcgaaagacgatagcgagaaataccagacgttctggaaagaattcggtctggtgttgaaagaaggtccggcggaagatcacgcaaacaaagaagcgattgccaaactgctgcgctttgccagtacccaaagcgaaggcgcggcgcaaactgtctcgctggaagactacgtcagccgcatggtagaaggacaggagaagatctactacatcacggccgacagctatgccgccgctaacagcagcccgcatctggagctgttccgtaagaaaggtatcgaagttctgctgctgtccgatcgcattgacgagtggatgatgagctacctgaccgagttcgacggtaaaaccttccagtctgtcagcaaagctgatgatacgctggataaactggctgacgaagagacggaagagcagaaagaagccgaaaaagctctggagccgtttgttgagcgcgtgaagaccttgctgggtgagcgaattaaagacgtgcgcctcacgcaccgtctgaccgatacgccagcgattgtgaccacggatgcgaacgaaatgaccacccaaatggctaaactgttcgccgcagcaggtcaggacgtgccagaagtgaaatacatctttgaaatcaatcccgatcatccgttggtgaaacgcgtggcggagacgcaggatgaaactggctttggtgagtggattgagctgttactggatcaggcactgctggcagagcgcggtacgctggacgatcctaaccagtttatccgccgtatgaaccagttactgacggcgtaaaacgataaaaccggtgataacctcaccggtttttttctttctgcgacgctggccggctgtcggtgagcggttttgttgcgcaaacgccacgaaatcccttcagcttcggccaccagtccgaaaatggcctttgactgacctgacgcactgctatcgcgcgctaaagccagtacactagtttttcctgacccgccgttttcttgtgatgggcgggtcataatggtatgttcttccgcttctcagattcatcaatgcgattcgcaaggggatttacgcaatgcgtattattctgctcggagctccgggcgcaggtaaggggactcaagcccaattcatcatggagaaatacggcattccgcagatctccactggcgacatgctgcgtgcagcggttaaagctggcaccgaacttggcaaccaggcgaaagccatcatggatgccggcaagttggttactgatgagctggtcattgcgctggttaaagagcgcatcacgcaggaagattgcaaaaacggtttcctgcttgatggtttcccacgcaccattcctcaggctgacgcaatgaaagaagccggtattaaagtggattatgtgctggagttcgccgtaccggatgaactgattgttgagcgtattgtgggccgccgtgttcacgcgccgtcaggccgcgtttaccatgtcaaattcaatccaccgaaagtggaaggcaaagatgacgtgaccggtgatgagctgaccacacgtaaagacgatcaggaagaaacggttcgcaaacgtctggtggaataccatcatctgactgcgccgctgattgcttactacagtaaagaagcggaagcgggcaacaccgagtatcacaaaattgacggtacacgcaatgtggccgacgtgagtgcagagctggctaagattctcggctaagcttattggggccgggttcgctggccccttttgccgttatcgcttttctctcctgcctctccgtgaccattcccttcgttttctcgcatcccctcatcaagaaaccataatcagcaagataagcccggctgcgacgggttaatttagtgccagaatgcgtcctgcttgtcagcaggcagtctggcaaccctgacagaggtgcgcagtgaaaacgtggtgcacgacgttgggttgaaacgtgcagatatctctgtgctgaatgccgatgaagaacacattgagatgatgatgcaatgggtcaacgcgcgccgttaaagtcatggcagagaatgtgatatgcttctctgcctgtttttcctcacggcagttaccatgaaatttcccggcaaacgtaaatccaaacactacttccccgttagcgcccgcgatccgctgttgcagtcctccccgtttgatagtgaagacggcagttgggtggtcggcatcgatcagacgctggtcgatatcgaagctaaagtcgatgatgcttttcttgttcgctacggcctgagcgccggtcattcgctggtgattgacgatgccgttgcggaagcgctgtatgctgaactcatgcgtgatgaactggtgacccatcagttcgcgggcggcacgattggtaatacgctgcataatttctcggtgctggcggatgaccgttccgtcctgctgggcgtgatgtgtaacaatatccagattggcggttatgcctaccgttatctctgtaatacctccagccgaatggaccttaactatctgcagggcgtagacggcgcgataggtcgctgctttacgctgattggcgatcagggcgatcgtacctttgccatcagcccggggcaaatgaaccagcttaaggcggaaaacgtcccggaagacgttatcgcaggcgcttctgccctggtcttgacctcctatctcatccgctgtgaagcaggtgagcccatgccagaggcaacgttaaaagcgattgaatacgcgaagcgccataacgtgcccgtggtactgacgctgggcaccaaacatgtgattggcgacaatccacagttctggcgcgattttctgcgcgatcatgtttctattgtggcgatgaatgaagaagaagccctggcgctgacgggcgaagccgatcctctgctggcatcggatatcgcactggaatgggttgatctggtgttgtgtaccgcaggaccgaccgggttgtatatggccggttataccgaagacgcgtttaagcgcaaaacgaatcatccgctcttgccaggcgcgattgcagaattcaacctgtacgaatttagccgcgcgatgcgcaaacaggattgccagcagccgttacgcattttctctcatatcgccccttatatgggcgggccggagaagataatgaatactaacggggcaggggatggcgcgctcgcggcgttactgcacgatattacggcaaataactatcatcgccgtaatgtgcccaattccagtaaacatgcgcgcgcttatctgacctattcgtcgctggctcaggtttgtaaatatgcgaatcgggtcagttatcaggtgctgaatcagcactcgccccgactgacgcgcggtttacccgagcgggaagacagtctggaagagtcttactgggatcgttaagtccggagagataaaccgccccgcatcgacgcaatgtgatacggggcgtgagtcaggctgcggcgcttagcagtggccttcactggccagcttgtgctgctcctgcaccatgtcgtcctgcagtttctgaataatgctggcggcaatctcgcgttcgcccatcaccacatagtttgcgccgcgttccagaatgtactccacctcatcgtcgtaatgtgcatgcacaatgatgttgatgtccgcttttttctggcgggcggcggtgacgatttctcccacctcgtaaccgttgggaatcgtgatcagcagccaggacgcacagtctacgcgggctaacgccatggtgtcggcacgggcagcattggccagcaccgcccggacaccctgatcgcgtaacgctttcacgcgtggaatcgaactttcaaccacgactaccgggatattgagcgccgtcagttgttcacacagcaggttgcctacgcggccatagccgacaatcaccgcatgctgacagacatcaacgggaatttgctgctcttcttccagcgcctcttccagcgtctgttgctccatcgtttcgttacgggacaggtaacggcccagcaacgtaaacaggaccgggttgatcataatcgagaggatcgcggcggccagcaccaggctacgcccttcttcatccagcaggccgagcgagatgccaagcccggcgagaataaaggcaaactcaccaatttgcgccaggctgaccgagatggtcattgcggttcggcgcgaatggcccagcagcgataccagcagccaggctgccgcagatttccctatgacgacaatcaccagcgcacccagcaccgccagcggctcttttaccagaatcatcggatcaaacagcatcccgacagagacaaagaacagcaccgcaaaggcatcacgaagcggcagcgtgtcacgggcagcgcgctggcttaactcggactcattcagcaccataccggcaaagaaagcgcccagggcaaaggaaacatcaaagaactcgacggcaccaaacgcaatccccagcgccagggctaatacggccagcgtaaacagctcacgcgagccggtggcggcacttttcgccagaatccagggcacagcacggcggcccaccaccatcattaacaccataaaggcggcaaccttaccgatggtccagaccagatcccatatcaccaggctggcgctggcatttccctgctccatcatgccggcaatggcgggtaacaggaccagcgtgagcaccattaccaggtcttcaacaatcaaccagccaatcgcgatttggccgcgctggctttcaataagctggcgttcttccagtgcgcgcagcaacaccacggtactggcggtagaaagacacaaaccgaacactaaccccgtcatccatgaccagcccatcgcccacgacatcagcattcccagcaaggtcgccacggcgatctgcgcgatagcaccgggaatggctatccgctttaccgacatcaggtccttcagtgagaagtgcagaccgacgccgaacatcagcaggataacgccaagttccgccagttcgggtgccagattggtatctgccacgaaccccggcgtaaaaggccccgccagtacgccggcgactaaataacccaccaagggtgaaattcgtaatcggtttgccagcatgccaaggagaaaagccaggaccagagccccgacgatagtcgtaatcaacggtgtggtgtgatgcatgccagtctccttggatgtaaatgtatccggttgtaacaaatgagtttaatgcatatcggaaaggatcgctgaataatttgtgggattaacagaaaaaaatatgcaaatacaagaaaaatgcaatcgaaaggctgtttttatcacttatcccgcttatcgactgattcagcgctgagccgagagcacaacattaaaattttactccccttaaatgacacagaggtgacgtcgatgacgcgctaatgcgctgacaacagtcactaaccgcaaccagatcgggatttgctgaagccatttagccgcctgggtcggaggggcagattacgcaccgacctgacgtatagctgcctgtcgtggaagtgatgctaaaacaatctattgtgatggcataacggaaccgcgcggtgaagatctcgggtatgtttatttttacgacgtacgcatcaatgcggaaaatcattatgatgttaacttcatcaacataacgatgaagctgttaaccctgttggttatttaataaacaacagaataacggtacggcaacatacgcgcgtcctgtatttgcggtgttagagtgcgcggcagctaaaatcgaaccactggggttgcctgtcaggccacattaccggccatactggaacagacaacgccttatggactctgggccaccgcggttaagatgcggatacagaaagggcctgtttcccgcaggattaaacggacaatcattaaaggagaagggctgtggtgttatctcgatgggcaagagcaggtctggcactactggtgatgctgtcatccatattaacccaggccgcccagcctgaccggagctaccgtttcagcattctgcacaccaacgatcagcatggtcatttttggtttaatgagcagggcgaatatgggctggctgcgcaaaaaacgctgatggatacgcaacgttacgccatccaggccaaaggcggtggcgcgctaattttgtctgcgggcgatgttaacagcggcgtgcctgaatcggatgaactggatgctgaaccggatatccgcggtatgaacctgattggctatgatgccatgacattgggtaatcacgagtttgataaaccgctcgccgtcctgcgtaaacaggaaaaatgggctaaattccctttcctggcagctaacgtctaccaaaaaagcactggtaaacgcctgtttaaaccctgggctgtctttcagcgcatggggttgaaaatcgctgtgctcgggttgatcacgccagataccgccaaattgacgaaccctgcacagctaaccgacatcgaattccgcgatcccgttaccgaagcagaaaaggccgtggccgagctgcgtgccagcgacaagccagacgttatcgtggcattaactcatcttggtcattacgacgatggtaagcacggcagtaacggtataggtgacgtgacgctggcgcgcagtctgccgaaaggcacacttgatgtgatcgtcggcgggcactctcatgatgcggtatgtatggaaaaagagaatgtcagtcgtaaagactacctgccaggccaaccctgtcagcctgaccgtcagaacggcgtatggattatgcaggcggaaaaatggggcaaatacgtgggccgcggcgattttatctatcgcaatggggaattaaccctggaggcctatcaactcataccggttaacctcaagcacaaaatcaaaaaccatgatggcagtgagtcctggcttacctggcagcaagcgatccccaataacaccgcaatgatgaaattactgacgccttttcaaaagcgagctgatgccaaactattggtgaatgtcggcagcatgaaaggggatttccccggcgaaaaagagacagtgcgctttacacaaagcgctatcgggcagttgatattgcgtgcacagatggcggcgacgcaggctgactttgctgtgatgagcggcggcggtatccgcacttcgcttaaatcaggcccggtaacctggcgcgatctgttacaggtacaacctttcggcaatcatgtggtttccgtgacgatgacgggcgcagaaatcagacgctatctggcggtggtggcaaatatcaaacccgattcaggcggcttcgcccagttagccaatgtcagcctcatcgctaacggcaatgcagtcagtcaggtgagcatcaacggccagccgttggcggatgaaaaaacctaccgtatggcgacgaacagttttaatgccgcaggcggtgatggctatccgcgaattgatacgcatccgggttatgttaacagcggcaagccagatgcccaggtgttgcgagactgggtgagcacgcattctccggtgaacgtcaacgactaccagccgcatgaaagtgttatctatcaggctgcgcccgcggcaacgccgcagaacggcgcgaaagaagcgacgccgcttcggcgctatcccaaaatggtgctgacatggatccgacactggaacagtgaaagcgcgacgcagcattaagcacgagcagggaggcggcctccctgctgtttatcaggcgcggcaggatttgcgggctaaccagtgcggacgcagcttgtcccagaccaggttgtagacaaaggtgtagggcagaaagaacagaaaaaacgccacttcgatcaaaaaggcctgccacagcgaaatctccagcatccaggcggccaatggcaaacctatcaggataaaaccgccctcaaaacccagcgcgtgcaggatacgaagcagggcgctgcgtttctgcccggccgggtaaaaccgatcaaacacgctgttgtaaatcatattccacagcatcgccaccgtagacaacatgatcgccagcgcacccatttgaaacaggggtttatccataatccatgccgccagcggggcgatagtgacgatggccaggccttcaaacagggtggcatgtgcgatgcgttctgtgattgaacgggtttgcatttcgatctcctttgttcaggttgcgcattctcccacgtcaaaatgctaagataaaatgatcatctatcgataaaagcgatggtttacatgcgttattcaccggaatctctggaagcttttgtacagaccgtggccagcggatcgttttctgccgccgctcgtgcactgaaaaaaagccagtccaccatcagtgtggccgtggtcaatctggaagaagatctgggttttgccctctttgaccggcgcggtcgccagccacagctcaccgagcaggggcaacgcgtgttgcctcaggtgcagcaaattcttgccgccagtgagcgactggacgcgctggcaacgcggctgtctgaaggcgttgagccgcggctgagcgtggcggtgtcagacttttggcaaaccgactaccaccagcgtttactgaagcagtttgaggcgcactacccggatgtggagctggaagggatcgcggcggaagatgcggatgtcctggagctgttgcaagagggacgggcccacattggagtgatacgtgcccagccgacgcttcctgccgacatcgcggtcgcccggctacaggtcgatgccgagttaggtatttacctgcatcgggatcatcccgtggcccaacaatcctcggtaaacgaaagtcagcttgaaccgcttcgtcatcttcgtcttaatacctggacagcgaaacgtgagagtgcgccgaaagggcgcgcctggtctgcgcaaacctattatgtgctgctggaaatggcggaacagggttttggctggagtattttaccccgctggctggtgaaacagtgcgggcacggtgtactgcgggaactgccaatagcgggatggccgcagcgcattgccgtcgaagtggtgtggtcacgccgcaatccgcccggtcccgctgggcgctggatgatcgatcaactctgtgcgctgccaccggcttaatcgcgccgggcgatatccgctaacggggcatccaacagccgggagagatcctgtgggctcaattcaatatccagcccgcgcttaccgcctgaaataaacagcgtggcaaagtcgttagccgagctgtcgatcaccgttggcaaccgctttttttgccccagcggactgatgccgcccaccagataaccggtgatgcgctgcgccagcatgggatcggccatctcggcttttttggcattgaacgcctttgccaccttcttgagatcgagctgggtggcgacaggcgtaaccgccacagcaaggtgcttagcctcgccattcagcgccaccagcaaggttttgtacacctgccgggcatccagatttagcttacggaccgcttcgtcaccaaaactggtttcgttgctgtcatgttcataaggatgcaaagtgaagctgactttttgtttttccagcagttttaccgcaggcgtcatagtattctcttattcggaaaaatcttattacgtattattgaacaataaatgtggcgaaataatgtgctttaggcgagaattgcctcgcgccagcaatcctgttgttggcgacaactaaaatcattaacacattcctctttgaagagccgatatgactgtcggctctctttttttctgcgttttattccgcgcgcatcaagcccggcaggttgttctcgccgtataaatgcagtgctccgaccgctaccacgtactgaccagcaggcagagtgcgtaaataatcgcaccactggctgttacgctggctaatcagcgtgtcgttcagtgtctgactgaaggtcgcaggcagagcaatttgcggctcgcgcggcgggctttccagccaccaactcaccatcgtttgcaacatgcgcgcgttagtgtgccaatgggtgagcgtatctgccagcagcgccatgccgtcgtcaggtaatgatttcagcaggctgatttgtgcctgcgcaccttccagttcaatcacgggtttatccatcgcccgcgccgcctgcagtagctgataatcaatgccgtaatcaggacgcaaacccagccgctgcgcctgctgcgcctgtaacatcagggcaatttgccaggccggtaacgtatcgaactggctcagggataaaccggtttcattacacagtgtttcaagcttcgccagcgcctcatcatccattctggcggtcagtggcggacgttcctccgtgttttcaaacggcgatcctccctgagtaatatccgcttcaacaaccagcgcgtcggctttttgtaactgctgtagcagccggaccggcaggggctgcatgtcacgagtgcccatatgaatgcttcctaccagatgaaaccggcattcgccagactgaatatctacggctggccaacgataactggtagggaaaagcgggttaatccagttacgtaaacgttgcaaaaggcgcgctgtcattccctgtccttcactgtgttaaagaaaccatgctagcgggatcgcgtcacgaaagacagagcagggcagttattgctaaacgcggggcttatagcgcagcaggcggttagcattactcaccacggtgatggacgacagcgccatcgctgccccggcaaacaccgggctgagcagcaggccagtaaagggaaagagcacgcccgctgccaatggaatgccgataatgttatagataaacgcaccaaacaggttctgccggatattgcccagagtggcggaggcaattttcaaggcatcgaccacgccatgcagatcggctcgcatcagggtaatcgctgcggtttccacagccacgtcgctgccgccgcccatcgcaataccgacatcagcctgcgccagcgccggggcatcattaatgccatcgcccaccatcgcgacgcgttgcccttgctgctgcaactggctaatcgcatcggctttgccttcgggcagcacgccagcaatcacctcatcaataccggcctcatgagcaataacctgggccgtattttcatgatccccggtcaacataatcagtcggtagcccgcatgatgcagcctttgcaaggccgcttttgcctcgggccgcagcgtatcacgcaagccaatcagtcccgtaagctgcccgtcttctgccagcaataccggcgtcgcgccttgccgggtgagtctgtcaatctctgccagagccggttggcaatccacgccgtgcgcagtcagcaggctgacattgccgagtaatagcgtcctgttgttgagtatgccgcttacgcctttgccgcgtattgtacgaaattgcgcaatatcggctcgaacagtctcccctgtttctgcaaggattgctttcgccagcggatgacccgacatctgctccagcgctgccgccgcagacagcaccgattgacgcgtactgccgttccagttcaccacgtcggtgacctgcggcgtgccgcttgtcagcgttccggttttatcaaacaccagcgtatcaatatggctggcgcgctgcagtgcatccgcatcgcgcaccagcacaccatattcggcggcgcgtccggtaccggcgatgatcgacatcggcgtggccaggcccagcgcacagggacaggcaataatcagtaccgtggtcgccacgaccagagcataggccatttgtggcgctggccccgcgatataccagatcgcggcgctgagcagagcgataagcacgaccaccggcacaaacacggcagagatacgatcggccagacggcccacatccggcttactgctctgggccttacgcactagctgaataatgcgcgccagcgtggtgttgccgccggttgcgcgggcaataaagcgtaccgttccgtcctgcaccagcgtgccggcaaacaggctatcgccctgcgttttactttgcggcaccgcctcaccggtgagcattgcctcgtcgcaccaggcctcgccctcctgtacttcgccatcgacgggtacgcgatcgcccgccaccagccgcagagtcataccgggttgtaccgcactgaccggcatcagggtttccccctggtctgttatcactctggcctgatccggtgtcagatcgagcaggcgctccagggctcgggatgagcgctgacgtgcacgttgctccagcgcatgacccagattgatcaggccgagaatcatcacgctggcttcaaagtagagatggcgcgcctgctgcggaaaaaaatcaggccagatcaccacgctgaaggagtagatccaggcggcggccgtgcccagtgccactaaggtatccatcgttgcgctgcggttaaccaggctgcgccaggcgctgcgatagaagtgaccgcctgcggccatcatcaccagcagcgttacgatgccgagcacccgccaggtggtgtgattatccgcagtgagcatcatattgtcgcccagcatgccccagatcatcagcggcacgccaaacaacagtgcgatacctgcctgccagctaaagcgttgcatggcacgtcgggcgctgcgctgctgcttctcgcggcgttgctgttcgtcgtcgaccacttcagccccgtagccggctgcatccacggcggcgaccagctgatggggttcaacgttacccatcaccagcgcactgcgctcggccagattcacccgggcctgctgcacgccactgacctgctcaagggctttctctacccggctgacgcagctggcacagctcatcccctcgatgagcagcacgtgagcggccaggttttcggttgccggaagagaaggggactccgttgtcagcgcctccggcggcggctctgctgctgtcaacggctcaggctttgggcgggtgcccgcagcttttaatgttgcatggtagcccgcctgttcaacggtggcgatcagggctgtcgcctctgcatagcccgacacgctggcttcctgctgtgtaacctcagcctgctcgacatcgtcgcggccttcgagcgcttccttgaggcgttttacgcagtggccgcaggacaatccgtccagcgccagaacaatcgtgtttgacatggttgactcctttgtcggatgtgcatgattgcgcattcaaatgggattggtgctaaggttaaaccttccatcaaggggaaggtcaaggaaccaattatgaacattagtgccgtggcaaaaaagaccggattaaccagcaaggccatccgtttctatgaagaaaagggcgtggtaacgccaccattacgcggcgataacggctaccggcattataattcgcaccatcttgatgaactgaatttattgcggcaggcacgccaggtgggttttaccctggatgagtgccgcgagctggtcgggctgtttaacgatcccgatcgccacagcgcggatgtgaaagcccgcacgttgcaaaaagccgatgaaattgctgcacatattgaagagttgcacgccatgcgcgctcggctgctggcgctggcggcggcatgcccgggcaacgacagcgcggactgccccatcattaataacctggcaggctgctgcagtcaggttggcggcaagcgtgactgaatgcgcagggtgatcccttccactgcgacgacctcgaccagcgcgccggccggcaagttctggtctgcctgaacacgccaactgctgtcgccgatgcgaacatgaccaatgccattttgcaacgtgctgtccagggttagctgcaggccgatcatctggttgccgcgctgattaagtgagtttggctgctggttgcgctcacggtaacgcatcacgcgatgccagataaatacactggccagcgtcagcacggcaaacagacagccctgtgcggtccagctcagtggcaaaaaccattccgtgatgccgaccagcatggcggccagcccgctccagagcaaatagccgttcgtgccgagcatttctgccgccagtaataacccgcccagcgtcagccagaaccagtgcggatgtgcgacgatctcgctcaccatcagcgtttcgactcgttgcgggtttcttttaacagctcactgataccaccaatcgcacccagcaggctgctggcttccagcggcatcatgacgactttactgttactggattcaccaattttttgcagcgcatccgtgtatttctgcgccacaaaataattcaccgcctgaatatcgccagcggcaatggcttctgacaccatcttcgtggcgcgggcctccgcttcagcctggcgttcgcgcgcttcagcttgcaggaaggcggaggtccgctccccttcggctttcagtatctgtgcctgcttttcaccttctgcacgtaaaatttcggcctgacgcacgccttccgccgtcagaatatcggcacgcttggtccgctccgccttcatctgtgcgttcatggcaccaatcagttcctgtggtgggcggacatcacgaatttcgattcgggtgatcttcacgccccacggattggtggcttcgtcaacaatatgcagtaagcgggtattgatactgtcacgttgagacagcatttcatccagctccatgctgcccagcacggtacgcatattggtcatagtgaggttaaggatcgccagttccagattgctgacttcataggctgcccgcgccggatcgatagcctgcacaaaacagacagcatcaatagtgacgttggcattgtctttggagatgatctcctgagagggaatatccagcacccgttccatcatattaatcttatggccgacacgatccataaaggggacaaccaggctcaggccgggctgaagcgtgcgggtataacggccaaagcgttcgactgtccactgatagccttgtggaacaattttcacaccggaccagacggtgaccagggcgaccaggataagtacaggaatgacggtgagcatataacctccaggttgtcagatgaacgggccaaatcgttcggcccgttttctgcttacatcagtaaagcagggaataaagctgacggcgatagcgtgcggcaagcgcatcgcctgtgcctaatgccgccagaatctcctgcaacattttacgcgcctgaccgtcagcggcgttcagatcacgcttaataacgttaaacagcagttccagtgcttcttcattacgaccgacctgatgcagttgcagcgacagtttggtcgccagttcggcgttttccgggtcagtttccagttgggattgcagttgctgaatttcgggtgtgtcagccgcctgtttcagtaaatcgatctgggcgatcaggctctgataacgggtgtcctgatcctgcaacggcacggcgttgagtaccgtttcagcctcatcactgcggttaagggtaatcagcacctctgccagcagaaaaccgatttcgctgtctttgttgctaagctgccaggcctcttttagcagaggtaatgcgtccagcggtttgccttcctgcatcagcgccatggcctgctgagcttttaactcttcttcgcgcggcagcactttttccagcagtgcgcgcacggcatcttccggctgtggtccctggaaaccgtcaacaggctggccgttctggaacaggtaaaccgtggggatggagcgcaacccaaattgggacgccaccctttgttctttgtcacagtccagtttggcaaggataaactggcccgcatattcctgagccagccgttccagcacaggcgtcagttcctggcaatgttggctgcgatccgaccaaaagtagaacagcaccggtatctgcattgactgctcaagggtctgttgcaggttggattcgttaatgtcgataatcgaagcgtgtggtgacatgactaagtctctttgcagaaaatgtttaaagaatatggggccgaccgcccctgcttcaagttgtattcgcgcaatacctttactgactgcgaattatgcgatccagtatccagcctggcagcaggcgtttcaacaggcccatcgcgtgtgcgaccagcgtcaccggataacgtaaacgtggatgtttgctttcgagcgcatggcgcagcttaggtaaaatggcttcaggcggcagcgtaaatcgcgccgccagaccgggattcagcaccggattatcctgctcgccctgcgtcacattatccgtgaagcggctctggattggacccggttcaatcaggctgacgcgcacgccgctggtgtgcagctccatgcgtaatgcatcgctccaggcttccagcgcgtatttactggcagcataaacgccacgccccggcgtggaaatcaagcccagcaccgaactggtattaatgatgcgggcattgccaaacgcctttaaagcagggagcagccgcacagtaagctgatgggtgccaaacacattactggaaaactgctgttcgaattgctgacgcgtaatggtgtttaacggaccataggtaccaaagccggcgttgttgaacagggcaaacagccggttatcggtgagcgccaaaacctcatcggcggcgcggtcaacgctgtcaggatcgtccagatccaacagcagcccggtaaagcccaggctttgcattcgcgccacatcttcagctttacggcaggccgcaatgacgtgataaccgcgcgccagcagatcattagccgccaccaggccaatgccgctcgaacagcccgtgatcaaaatggttttttgcatgtgttaccttttttgcacaactactgcttaactaatggggtcagttctttcgccatcagtccggcgataaagggttgggcatcaggattgggatgaataccatcctgctgcatccattcgggttttaaataaacctgctccataaaaaagggcagtaaaggaatgtcatgctgtttcgccagttgcggataaatcgcgctgaacgcatccgtatagcgacggccatagttagccggtaaacggatctgcatcagaatcggtttagccctggcggctttgacctgctcaatgactgtacctaacgtttgtgcaatatccttcgggggaaagccacgtaagccgtcgttaccgcccaattcgattaacacccactgcggttgatgctgttttaatagggcaggtaagcgcgccagtccttgtgcggcggtatcgccgctaatactggcattaatcactctgggctgctgctgccaggttttatcgagcaggctgggccaggccttactggccgacatctgatagcctgcgctcaggctgtcacccagtaccagcaacgtatcggccgcagcaagacgggacaccaacagacagcacaataacaggaaaggataatgccagcggaaaacattcttgaagttcatcatcttactaagtccgtgggtcagggagagcatcagttaaccatccttaccggagttgagttagttgtcaaaccagctgaaacaatcgccctgattggcgagtcgggatcgggtaaatccacgctgttaggtattctggccggtctggatgacggcagcgacggcgaggtgcatctgctaggccagccgttgcataaaatgaatgaagagcagcgggcagccttacgagcgcagcaggtgggatttgtgttccagtcttttatgctggtgccgacgttaaatgcgctggaaaacgttcagttgcctgcgctgctgcgcggtgagagcgaccgtcagagccgcgaccaggctcgagagttgctcacacagttaggccttggcgagcgtttgcagcatctgcctgcacagttatccggtggcgaacagcaacgcgtcgcgcttgcccgggcattcagcggtcgtccaggcctgctgtttgccgatgaacccacggggaatctggatcgtaaaaccggcgatcgtattgtcgacctgctgttttccctgaaccgcgattttgccacgacgttaattctggttacccatgacgagcagctggcggcgcgctgcaaccggcgcttgcgtctgcgtgacggtaaactgtgggaggcgcaatgatctggcgctggttctggcgtgagtggcgttcgccctcattgttaatcgtctggctggcgctaacgctggcagtggcctgcgtgctggcgctgggatcgatcagcgaccgcatggaaaaggggctgagtcagcagagccgcgactttatggcgggcgatcgtaccctgcgtaccagcacggcggccccgcctgactggctggcgaaagcgcaggaaacgggattatcggtcagccgtcagctgagttttatgaccatgacgtttgctgaccagacgccgcagctggcgtcggtgaaggccgtggataaccactatccgatgtttggtgaattgcaaacccgtccgccaggcgtaaagccccagcccggcactgcgctggccgccccgcgcttaatggcgctgctcaatctgaaagtgggcgatcaacttgatgtcggcgacacgacgctgcgcattgccggagaggtgattcaggagccggatggcggtttcaatccgtttgagatggcaccgcgtttactgattaacctggccgatgccgataagaccggggcgatccagcccggcagccgtattacctggcgctataagttttctggtaacccgcagcagctggaaaattacgatcgctggataacgccacaaattaaaaccggccaacgctggatcagtatcgagaattccgaagatgcgttggggcgttcgatgcagcgcgcgcagcagtttttactgttgtcggcgttgttaacgctgatgctggcgattgcggctgtggcggtggcgatgagtcattattgccgtagccggtatgatctggtggcggtgctgaaaaccctgggcgccacgcgcggcgtgttgcaaaagctgattatcggtcagtggctggcggtattactgctggcagccgtggcgggcggcgcggtgggactggcggtcgaagccctgttgatggcgatgctcaaacccgttctgccagcatccttacctgatgccagcctgtggccgtgggtgtgggccgtcggatcgctgtttgtgatttccctgctggtgggattacgtccttaccgcctgttgctggcgactcagcctttacgcgtattacggcgtgatgccgttgccaccgtctggccgctgaaaatatatttaccagcgatgggggccgtggtggtggcgctactggctgcgctggtcggcggcagtaaaatgctgtgggcgctgctggcgggggtggtgatactggcgggcctgctggcgctgcttggctggggcacgttactgcttctgcgccgtctgacggtgcgaagtctggcgctgcggttggcaattaatcgcctgctgcgacagcccgccatgacgctgagccagttggccgcgttttccctgtcgtttatgctgctggcgctgttgctggtgatgcgtggcgatctgctggatcgctggcaacagcagttgcccgccgacagcccaaactttttcctgctcaatatgacggccgatcaggtgccgcaggtacgtgacttcctgcaggcgcatcaggtgaaaccggaaaccttttatccgattgcccgcatgcgcctcagcgaactaaatggcaaagcggccgatcccgaacgggataatgcgctcaaccgcgagctgaacctgacctcgctggcggctatcccacagcataatccgctggtggcgggcagctggccgccgaaagcgggcgaagtatcgatggaggtcgacctggcggatcggctcggtgtaacgctgggggacagcttaacctttgagggggatacgcaacagctcagtgccaaaatcaccagcctgcgtaaagtcgactgggaaagtctgcggcccaatttcttctttatctttccgccgggcgcgctcgacagccagccactaacctggctcaccagcttccggttggataacaaccccaggctactggcgcagctcaaccgcgagtttccggccctgagcctgctggatattggcagcattatgcgtcagatcggccaggtgctgacgcaggtcagtcaggcgctggaaattatggtggtgctggtgaccgcctgcggcatattgctgctgatggctcagattcaggtgggcatgcgccagcgccgtcaggaactggtcgtgtaccgcacgctgggggccggcaagcgcctgttgcgcacgacattgtggtgggagtttgcgctgatcggcgtggtctccggcgtggcagcggcggtgggtgccgaagcggcgttatggggattacagcgtaaaatctttgatttcccgtggcagcccgactggactttgtggctggctttgcccttgtgtggcgcgttgttactgtcgctgtgcgggggctggctgggcgtgcgtttgctgaaaggcaacgcgttgttcaggaaattcgacgccgcataaaaacgccgtgcgcactcatgctgcgcacggcgattatcgtccttacagcctggctgtggcccagtgaagaccgctggcgtattcagcaggcagcaggggcagcaacgcatgcagtgcggctttcagtcgggagtgatcgctgtcggtaaggttgagatgacctaccttacgtccttcccgcaccgctttgtcgtaccagtgcaaatgcacaagcggctgctgtagccagtctggattgatggcggtgccaatcagattgaccatcaccgagggcgcaatcaccaccggctggggtaaggccagattcagaatcgcacgcaggtgcagttcaaactggctgattgatgcgccattctgcgtccagtgtccgctgttgtgcactctgggagccagttcattgatcagcaacccctgcggtgtgacaaaacactccattgccatcacgccaacatagttcagctcgtgcaggatagcgctcagcatcgcttcagcctgttgctgctgtagcgcatccgcctgcgggaaggcgacgctggtgcgcagaatgccgtcttcatggagattatgtgtcaggggataaaatacggtgctgccatcgtgaccgcgcgcgccgaccagcgacacttcacctgagaagttaatgccctgctcgacgatgcactcgccgtagcagtcgtcgggtaaggtcgctgtttcgttggcgcgtaatcgccactgaccgcggccgtcatagccaccggtgcgacgtttaacaattgccagctcacccagacgactgaaaacggcgggccattcgctcttgtctgccagcagttgccagggcgcggtggccagattgagctggtccagcagttgtttttgcgtcaggcgatcggccagacgcgggaaaatatcccggttcacaaaggctgaatgagacgccagttcacgcgtcagtgccgtttccggccagcgttcgatctcggcggtaatcacgctttctgctataggcagggcggcgggatcggcatccaggcccaccggatgcacagcaatgcccatcggctcgcccgcctggcgtaacatgcggccaagctgaccatttcccagtacacaaaccggcttcatgcttcctcccgcgggtccgggttagccagcacctcatcggtctgcgcctgacgccagttggccagacgtgacgccagtgcgtcgtcatgaatcgccagaatctgcgcagccagcaatgccgcattagcggcaccggctttaccaatcgccagcgtacccaccgggatgccgcgcggcatttgcacaatagagtagaggctgtcgacgccgctcagtgccgcgctctgtaccggcacgcccagcaccggcagcagcgtttttgccgccagcatgccaggcaggtgcgccgcgccaccggcaccggcaataatgacctgaaagccgttatctgcggccgtttcggcaaagctaaacagcttgtctggggtacggtgcgctgaaaccacttccacatggaagggcacgtccaggctggagaggatttccgcagcgaactgcatggtggaccagtcacttttggaacccataacaacagcgatgcgggccggggcggcattcgacgacatgcggtcaactcctgtgaatgaaaacacacctgaccaggcggacaggttttgaagggcacagagaatagcatgggaagcgcacaaggaaaacggttgcgtcgggattacacgtggtgcttttagggttttatcgacattctgttctctgacgttgacgcgcgagaaacgctgaactttagttaacagtgttgcaaggtgactgacatgatgagccgtgctgcacccggttggcaagaaatgacgttaactgacacaaagaggaacaggatgatttcacgctggcaactgattttcagacaaacaggcaggaaactgtggttcagggcaactttatttgcccttgctgcagttgtcagcgccctggcctccattgtctttaaatctgcgattccaccctcggtttcggtaaaagtcggtgctgacgcggtggacaatatcctgaatattctggcgtccagcatgctggcggtcaccacgttttccttaagtacgatggtaacggcgtttggttcagcaaccacacatgttacgccgcgagccacgaaactggtcgttgaagacagtacaacacaaaatgttctcgcgacctttattggctcattcctgtttagtctggtcggcatcatcgcactgaatatgggagcttatggtgaacaggggcgagtgatcctgtttgcggtcacgctggtggtcattgcattaattctggtgacgcttctgcgctggattcaccatctcacctcgcttggcagcgtagatgaaacgacctcacgtgtggaacgcatggcgcttgatgtttttagcgcgcgtgctcaatcctcttgtttcggcgccaggccctggcgggaaagcgatcgtcaacctgcgggcacgtttgctgtttattcggacgctattggctatgttcagcatattgatatggacaggctacataaggcgattaaagacagccctgtacatatttacttggtcgcgcaacccggattttttgttcatcccgcccgcccggccatgtttgtcacccacgccctgtctgcggaacaacgcaaactgatgttgtctgccctgacaatagccgcgtctcgcactttcgcgcaggatccacgtttttgcctgtgcgtgatggcagaaatcgcctcgcgtgcgctgtcgcctgcgactaatgaccctggcaccgccatcgatgtgatcgggcgagccgtcagaatactctcctgctatgcacgcgaatgtgcggtgccaacggtgatctaccccgccattcacgtcgcgcccttgtcagtagacgcattattcgatgattttttctcacctgtagcgcgagacggcgcggcgataaaagaggtgcagttacggttacttaaggcgctgggaatgttgtctgtcgcctggcctgatgtgtaccaggctgcagcgttgcgccatgcgcatgaagccatggcatacctggcgcgggaagagatcattcagacggacagagcacgaattgagcgcacatggcgcgaacaatttggcgcagactatccccatcccttccaggatgagaagctaaccgattggccctgtcagaagtcgaaatcgatcagttgaatcccgctggcatccagttgaatcattgatccacggctgtgccaggcacccagtacggcacgctgcgcgcgttcgccatttagcgacagatcgtgaatcgccgggcggtgcgtatgaccatgaatcagcaacggcacctgctgacgcaacatggcctccacgacggcatgctgattcacatccataatctccagcgacttatgctgattggcctgtttactgttggcgcgcatgcgttctgcaatgcgtttgcggataaacagcggcagcgccaggaacaggtgttgaatccaggggttatgcactttagcgcggaatttcaggtaaccaacatcgtcggtgcacagcgtgtcgccgtgcataatcagtagtcgatggccgtaaagcgtcagcacgcgctcttcaggcaagagcgtcatgccactggcgcgggcaaagcgttggccgatcaagaagtcgcggttgccgtggataaaatacagtggaacgggcacggcacgcagggcttcagcgacctgttgatgcagaggattaggatcgtcatcgccgatccaggcttcaaacagatcgcccagaatatagagcgcgtcgcagtggggggcttcgcgctgtaaaaaatgcagaaaaccggcggtgatcgccggttcttcctgacacagatgaagatctgcgataaacagcgtgcgcggcattactcgctgacggtcactttctgaatgatcacgtcatcttttggtacgtcctggtgcataccgctgcggccggttgaaacggctttgattttctcaaccacatccataccttcaaccacttctgcaaacacacagtaaccccagccctgcaggctttcgtcacggaagttcaggaagtcgttgtcagccacgttaatgaaaaactgtgcggtcgcagagtgcggtgcagaggtacgcgccatcgccagcgtacctttggtgtttttcaggccgttgctggcttcgttacggatctcttctttggtggctttctgcttcatgccaggctcaaaaccgccgccctgaatcataaagccgttaatcacacggtggaaaatggtgttgtcgtagaaaccttcacggcagtaatccaggaagttctttacggttgcgggcgctttgtcatcgaaggtcttgatcacgatatcgccatggttagtctggaaagttaccatttttttcgtcctgtaaaggttgtcgtcagtagcatagggtgcgctgttagggtgcacacgcctttttctcgaacgttcttatatcataatttccgataatacgtcagccaggctgcgcagttggcttgctttgcatcgcgtgacagataaaaatacggcacaatatcaggatacttaaaacggtgcgttacgcacgcttactacggaaaccccaatgctgaagatttataacaccctgagtcgacaaaaagaggaatttacccctattcatgctggcaaaatcggcatgtatgtctgcggcatcacggtgtatgacctctgtcacattgggcacgggcgcacgtttgtggcttttgatgtggtatcgcgctatctgcgttacgtcggctatgacgtgaattatgtgcgcaatattaccgacatcgatgacaaaattatcaagcgcgccaacgagaacggcgagagcatcgaaaccctgaccaatcgtatgatcgccgaaatgcacagcgattttgatgcactgggcatcttaccgccggatttagagccgcgcgccacgcgccatattcctgaaatcgtcgaactggtggaaaagctgattgcccgggggcatgcctatgttgcggataacggcgacgtgatgttcgatgtgctgagtgacgtggactacggtgcgctgtcgcgtcaggatctggaccagcttcaggccggtgcccgcgtcgaagtggcggatgtgaagcgtaatcccatggatttcgtcctgtggaaaatgtctaaagcggacgaaccctcatggccttcgccctggggccagggtcgtccgggctggcacattgagtgttccgccatgaactgcaaacagcttggtgcgcatttcgacattcacggcggcggctctgacctgatgttcccgcatcacgaaaacgaaatcgcccagtccacctgcgcccacgatggcccgtatgtgaattactggatgcactccggcatggtgatgattgaccgtgaaaagatgtcgaagtcgctgaataacttctttactgtgcgcgacgtgctgcagcattacgatgccgaaacggtgcgctacttcctgatgtctggtcactatcgtagccaactcaactatggcgaagacaacctgaaccaggcacgcgcggcgctggaacgtctttataccgcgctacgtcataccgatcgtaacgtggtcgcccacggcggcgaagccttcgaggcccgtttccgcgaggcgatggacgatgattttaacaccccggaagcctattccgtgctgttcgacatggcgcgtgaagtgaaccgtctgaaaagcgaagacatgacggcagccaatgcgttggccgctaagctccgtgaaatcgccaacgtgctgggtattctgcaacaggagccagaagtgtttctgcaaagcagcgcaaagggcaatgatgatgaagtggcggaaatcgaacactgggtgaaagcccgtgctgatgcgcgcgcggctaaagactgggcgcaggccgatgtggcccgcgacaagctgaacgcgcttggcgtgattgtcgaagatggcccccagggctccagctggcgacgcaaataacaggcaacacaggagagggcgaggcatcgcccttttttgtctatgacgataaaacagattcaccttcgtggttttcgttcggtacgtgatctgattctgccgcttcagcaactgaacgtggtaagtggaccgaacggctgtggcaaatccaacctctataaggcggtgcgcctgctgcacgaggccgccaatggtcgcctggcgttagcgctggcagaagagggcggtattcaaaaagtcatgtgggcaggggaactacatcgcagcgctcgtcgtcaggatgccagccgactcatcctctcggtcctgatggatgacatggattttgagcttgcggtggggtttcctcagaagcttgagaccagcctgttcaacctcgatccgctggtcaaagaagaacacatctggcttagtggccagcagcgacgtccttcttcctgcattatgcagcgcacgaatcagaccgcctttttacacaatgtagagggagagcgcgtaagctatccggcggtactgcatcccgaagagtccctgtttggtcaacttggtgagccacaccgctatcccgaactttctcagatgcgtgaacgtctgcgccagtggcgcttctatcatgagtttgccgtctggcccggttcgccgattcgtgcgccgcaaattggcgtgcgcgcccccattctggcgcacgatggcgctaacctcgcggcggcatgggcaaccattgtcgaacggggtcatcacgagttgctttataaggtgatagctaaagccttccctgataccgaatttcaggtggatgtccagaacggtcgtttccagatgctgatgcggcgacaaggcattttgcgtccgctggaaagcgccgagttctctgacgggacgctgcgtttcctgtgccttgtggtcgcgctgctcagcccgcgcccgccagcctttatggcgctcaacgaacccgagaacagcctgcatgaggatctgctaccggccctggcggcactgattgccgaagccagtcagtttagtcagttgtggatcaccagccattcacccagactggccgcgctgattgcgcagcatgcagaggtgaatcacattgagcttgagcagattaatggggaaacacggatagtgggagaagcacagctttaaggcgccccgggcggggcacctgacgatcaggcaacgacggtgatgcgctgcccggcaaactcaactgtttgcccctgatgaattttgcagcgcttacgggtttcgacttccccatcgaccaggacttcaccttcaccaatcaccactttggcctgtgcaccgctttccacccagccttcaagtttcagcagatcgcagagatcaacgtgtgggaacttacccaaagaaaaagtcgccattatgcctgctctccatcgtgaaactcttcacatgcctgtaaggtattttcgattaaggttgctaccgtcatcggccccacgccgccagggacgggcgtgatataagaggcgcgctcagcggcggcgtcaaaattcacatcaccgacgactttaccgttttcgagacgattaataccgacatcgataacgatcgcacccggtttgatccagtcgcccggaataaagttgggcttacccactgccacgatcagcagatcggcatgctcaacgtgatggcgcagatcgcgggtaaagcggtgcgtcacggttgtggtgcagcccgctaacagcagttccatgctcattggacgacccacgatgttcgacgcaccgacgaccacggcattcaggccgtacgcatcaatgttgtagcgttccagcagcgtaacgatgccgcgcggcgtgcacggacgcagcttgggggcgcgctgacacaggcgaccaacattatagggatggaagccgtctacatctttatcgggcgtgatgcgctccagcactttgacgttatcaatgcctgccgggagcggcagttgcaccagaatgccgtcaatttctgtatcgttgttgagtttatcgatcagctgcagcaactcggcttcgcgggtggtggcgggcagatcgtaagagcgggagataaagcccacttcttcacaggcgcggcgtttgctgccgacgtagatctgcgatgcagggttctcacccaccagaacgactgccagacccggtgcacgttttccggcggccaggcgctgctttactttttctgcaacctcaagccgtacctgctgcgcaatcgttttaccgtcaataatttttgctgccatcagagcgtaaatccactgtgttgagtttaagtcggggatggcacctattttgtcagaagcgcgtccggctgtcaggtagagattcttgttgcagggtggttgacaatatttagccgtgacgaaagtgcgggttaacgcttatgatgccagacagggaatttactggatgacgtgatgatttggttaatgattgccaccctggctgtggtgtttgttgtaggatttcagttgctgactgcgggttctcgccatgctgcgcaggcgctcagcaagcggctgcaactgccgccggtccatattgaatctatgttgtcgcagatgggtaaagaggcggcgaaagagtttaccgactacatcgccggcgataacgaagcgcatttaaataatggcgcggcggtacttttgatctggcaggtactgattgtggatggcagcgacgaaaatatccggcgttggcacagcgtgttaaccggcgcaggtttttctgccacgctcactcgtcagcaactgttactggcattgggttttctgcgtcagctcgaacccgacagccaggagctgaacgaactgcgcgagcagtataatgcgcgcgtcacgcagcagggcattgagctggaaggggaaactaccgaggtgagtaatctggtgtcgctcagtgcctggcgcgaccgccattagtggaaattggttattacctgggcacttaccgcgccaccgcggcaaaaacgttgacgttacagcgttcaaccgtataattcgacgcaacctctccgcgcccttagctcagttggatagagcaccggccttctaagccgtaggtcacaggttcgaatcctgtagggcgcgccactttctcttctgtttacatcccttaaagtctacttttcccttaaaaatcagaacataaatcttttaactggtccatttcggttcagggtcacctgttgcgttcttatccaatatgggggaagtcagtggtacggtatgcatcaactcaacattgctgtatgacaaaaatattgaggatgtgtgtaatattcttaggcgaaaaaaataccagaacctgctttttaaatgcaaagaaataaaaccagcgttttcctcatgcgcgttgtctacaataaaaaatagtaaaagctggtctgtggaaagaccagcttttattcaataattttcctgagaaccgggaaaagataaactttaatctttgataaaactgtttgcagaaaatactggagcgctttcttttaccatcttctctgcttcagtattaatacgatgttcaaatacttctttctcgataatgaaatctttttcctcaataaccagtttgtaattaggtatgtgttcagatatgtactgaatataagttgttacgtgcagcttaaaaggtaagttagaggatagtttatccacttttattgctttatcaccggataaaccttgttgctcgttagcccgatttgctattttggttaacgcattatgaatatcgcctgagaaattgtttggatctaaattagtcaggtttatttcttttggtgcgttatccgatgcagccgctaaggtaatatccatcccacgtttttcactataaatttcaccgaggttcacactacctgacgtagtcttaatgacgtgtttttcttgaaggatgagtcctttgttaaccatcgctgcacagaaaatggcaccgcccagaataagagatgatacgagcaatgggacgccatactgttttgcattcataaagttaagtccttttggttgatgattttttatcgggttattatacatcaaattgataagtactaaccctggaaaaggatggtttatttagctttattaatgcttttgcaagcgcgtaaaaagtgaatgttatttctgataacggccttattgaggctgagccagtgcgaaaggttcctctggcttatgatgtttttatgaactaaaccgtttggcagaaaaattatttatgcgttattttcactgaacattaactattctttaaacaaacagtcgctaatggcttttgtctgaaatctcagcttaaagcacagtatgtttattcctcgtttattccgctttctttaccttattcattaccagtaagcgcataggcctcccttttcgtaatgagttcatccagttttaagtgaaattgagagaaacattgcatgaacaatgaggcatatgtctgagacgaaccgggtgaaggtctcatctgtacagcttacgcacgaacattatgactgaatcagcatggacagggtgaagtttaaatcagtccattaacgtaaaaaccggtagggcaggccagtaaatcgtgaatacaagacattgccagaggggctttcctgttacgcgggctgcaggcccggaaagctttttacctcaaacatttgccagtaaaagtgcgacttacatatacccgacccgaccttttttacctgcatctcagcaaatctcactcctgttgtgcatggttgtcttcaccttctggttactaccggggcttgtgggtcatgagccgtggaagccggatgaggcttatacctttgggctgatccgtcatattgcccaaaccggtgactgggtagtacctacgctggcgggcgaaccctttatggaaaagccgccgctctatttcattgtggcctcgttcttcctccggctgtttagtccactactgggcgaaccggatgcagcgcgtctgacaacgggcctgtttatcttgatcacctgttacgccatcgcgctgacgtcccgggagctgtttggcaggggagcgggccgctgggcggtgcttattctgtttgcctgtgtcggttttcctgtccgggctcaccagatgattacggacactgctttgctggcaggcggtgcaattggcatttacggtttcgttttgggaattcgccgccacatgttgggaggaacgatattgggcgttggcgcagccatcatgttcctgtcaaaagggcttctcggccccggcattcttgggctaactgcgctggcgctacctttgctgaatgcagaatgtcgtagcagacgctatgccatattttgtgccatcgcggtgctggtcttttgcccgctggttgcaccgtggttatatgcgctctggatgcgttcagaaaaactgttttcaacctggctgctggtgaataacgttggccgtttcgatggcaccgctaaacttggccccaaagcgaaacactttttttacttcaaactgcttccctggtatgcctttcctgcattgccgatggcttcatggtggctctggcgcacatggaaaaccggcattagtgcccctgcgaaggtgctggtaacgtttttttctgccggtttcgttacgttgtcagtcgcttccgatgcgcgtgagctttacgccatgccgctgcttctgccgctggccatactggccgttggagcctgccagcagaaaagcacctggacagaaaagttacgcccctgggcacttggactattctgcctgctccctgcggttatgtggggggcagggatcatcctgatgactggctggcctgcaccgttgtggaacaaatgggtcttgcacggcgcacctggcttcacgccgcagctctctccggtgatgcttattgtggcattactggcaacgctgatgctcagcgggctggtgttgcttaaccgcacctgtcggcaatgtcctttagctgtttttaccagctgcatcacgctgtgctgggttttagccatgacattgggcatgccgtacctggattatactaagcgctattctgatgtgtttatcccgttgcgggcctggttgccgaaggatgagtgtgtggcaagcaagcaccttggcgagccgcagcgagctttactggaatattatgacgggctgataacattacgagaagggaagcacagaggtgcttatcgttgtcactggctgctggtgcagcatgataaaaagcaccctgaagagtatgtcgacggaacattggtctggcagggggaaaggcctgcggataatgaagagaactaccagctttaccgactgaacaggtaaaccgaaatattacggacttaacgcgcctgcgttcatcctgcaggcgctgttaatattccacactgacgctatcgtcattcaggggagtgaaagatgaacttcattttcctttggcgcccagtccctgtccgagaattcatcaacagaatgggaaacattgcgcagcccctgggtgccaaggaagtttttgacgccttcctgaaggtttccgtctcggaaaagttcggcaataacaaacagcgcatcggaaagtgacagcgttctgatttgagcaggtagccagtttgtacgcgtaaagatcaggtgataaagcgcctcctctcctgataaaggaaaatagcgcgtaccaaattgtttgcggtgtttgtccagaatgatttcaagaatgaatatttgagccgtacgttgcctgatctgattaacaaaaacattttcggaattgcccatatccagcgtcgtggcatcgttgttctgcttgacgcgcgtctcaatagcattccagagattgtcatactgattcatagcttaccttgtccgaaagtgtcgttatcataacaacgttagcagaaggaactcgtgcggcaaaggttgcaagcataatcagccgctttcggacgtaaaaaaacagttttgggttttactgcttcagtgccgctgcgtagtgccctgcaaagttgggctgtgcagtatgccgtttttatgaagcggagaaagcaaaatagcagaacttacgtttgatgcagtgaaaacaaaaatggccacaaagggccatgtcgaggaattcagacgcgattaatgcaacacaccggcagtggataaacaaagtgtgcaaaacgcaacgctgaatgcagagaaacccaccagaccaagaacgacgaaaccgaaatttctcatatcgacctccaccgtgtccaggtgacacagccaaatcatagggctggcgggtaaaaaagtacatactgttaataaagacatggaaaatactgctgtgacattcattaaatggctattctcgtcgttttaccggatttaaacgtggattattgtttgttatctaaagcatcccactcatctatttggccagatgctcatcgcctaaatcagataaaaactgcgtttaatctattataaaaatcttattgtcttttacatcagtcctgacgcttcttagagacgttggttacctgaacagaattgtccaaagctgactggccgttgatgggtactctattttttacggtgttatctgaggggctatgatatggagcatctttatatattgattttatcaacactcaaccccagcggatccacccagctcagcgggttaggtgcatactgatacaggttccagccgccttccagccctatcgggtcctgaaccgtgaaccgtcccacctgcggatcgtaatagcggaacagattgtagtgtagaccggtttcgctgtccgcatactggcccgcatagcgcagcggctgatggggcagggcagactgtttcgccagccgggtaaagccctctgtctgtcggcgcacttcaccaaaactgccgtactggccgctccagcggatgtcgccgcgttcatcggttacctccagcggtgccccgttgagatcggtattgaaccacaacacatcgccccgtccgccgtctgccatatgatcgatgcgcgccagcgggttccaggcctcgttaggatcgtacacataggtctggcactggccgttatcctgctgctcctgtaacagacgatagccctgccagaggaaacggatttctttaatatttttgttattagtttagctcagcaatggtgtgtcaattttgaccgatgattgtcttttaataacgaaatgttcgcttgaaaaggaagccagcagccttgctggcttcgtttttagtcccatcgttcatctatatatggtgtgatgctttcaattgttaaaaactttgatttgcaataaaaatcgagctcgttattttttatttttatttctgaataattttcaaaggactttattttcggggagcaaagaagccgattccagaaccagtggcatttaaatggataacatctccaaagttaatcaccaggctaagtgcattgaatccatccttcttccatttttcaggatgctttttcggtatttccctacaaaagaaatgaatttttaagtctgaaaagcgctccaatgaaaaacttgaaatttcgatgtttttaatgttcaattcattgccgaaaatgaattgaattttttctttacctatcgcatttttaaaccacatagaaataccttacgggaaattatagtggccatgagtaccaggaactgaactagcattcaggtttttaagaggtctgaccttaaaatgaggttgagccccatgaccagaagtagccttggcatgtcctaaactatggtcttgtagaagaacggactgaccttttttaccaacaaattcggaatgccttttttaattggctggccagtactgcctaatgattttttaccactcccatctaatagatcggattttgtgatagggccatagtgttgattcattgttattccagtcttccttttagcttgcctaaggcatccttgcggctgccccctttataagatgtcttcttgttctaagtatgtagtgcaattttgaaaagttaaaacatcgacggaaaagaatagttcatgatgaaggccagtttgctgtaagtcatatacgctaccatttttatttattgataaatgagcgtattctattttactccatttctttatgttaacaatatcaccctttccacctaaagcatgtatgacaattacattgtaatcaacaccccactttccccatttggctatttcaaatgcaggtttctgtttggtatgaatgtttaatgcaaggcggcctcctaactcgagtgatagttttccaataagaacattactttcaattccatcagggaatattttttttaaaaaattattgtaactaattaaatctattaggttcatgttaattactccacgggaaattatagtggccatgcgttccaggaaagtttccggcatctggcctttcaatggttcgggtattaaagtgaggttctgcaccatgtccagggggggctttttggtggcctaaactgtgctcctgtatcaacacagttttattgtctttgttttcaaaatgatattctcgcgttcttatcggcagattatctttgccgattactacattgccgttaccatcccttaattcaggccgcagaattttagttggttgctgattatttggtattccagcatcccttttagcttgcctgaacgcatctctgcgactgataccttcataagatgtctttttgtttggagcaccgcaattgctcaaccccagcggatccacccagctcagcgagttcggcgcatactgatacaggttccagccgccttccagccctatcgggtcctgaaccgtgaaccgtcccacctgcgggtcgtaatagcgaaacagattgtagtgtagaccggtttcgctgtccgcatactggcccgcatagcgcagcggctgatggggcagggcagactgtttcgccagccgggtaaagccctctgtctgccggcgcacttcaccaaaactgccgtactggccgctccagcggatgtcgccgcgttcatcggttacctccagcggcgccccatttagatcggtattgaaccacaatacatcgccccgtccgccgtcagccatatggtcgatgcgcgtcagcgggctccaggcctcgtataggtctggcactggccgctattctgctgttcctgtaacagacgatagccctgccagagtaatcgggtttctgtaatatttttccataaaataaattaattgctcctgagtgtggcaaagaacccttatataatttataaaaaaatatttgatattgatttgagatgaatatttaaattttaccttaatgataataatttcaataactaccatttggctttttcaatgccatattcgctactaagcacaacaaagcctctgctgaaatcctctttgataaagattctgtctctactatttttcatagtgtcaacgccactcaaaaaaaattctggattatctttgataattccacattttatttttaaaaaaaatacattgctttcagtaacgaagtatgtgatcagatattcaatacttgggatcgaattgatgaattttagaaagcattctttttgcgggttaatgtcaaatatatctttttcaagcactaagagatcgtaaacatgatctactacctcttgataagagatgctactaacttcgatgctatcttgcctgcatccagtttctgaagttataagttcgatcaatttctttaactgaccctttttttttgcttcctttaatttctcttgtaatgtcaggggcatctttttttttctcgcatatttgtgattccagttttactttcaggtatatgtccggagtgctgattgtaacgaacatttttctctaatggattcccatgcaaatcatcagcagtgtgtaaatgaggcccccggccaaatttgtcatcttcatgcataatgatatatttcttatcgccgttgtggttaaattcccatactgttctgttttcatatttagcgtcgaaaacctttacagcttgtggtgtattcgtatttttaggtatacctaatttccttttagcttccctaaacatagccctgaaggttgtgggaatattactcaaccccagcggatccacccagctcagcgggttcggtgcatactgatacaggttccagccgccttccagccctatcgggtcctgaaccgtgaaccgtcccacctgcgggtcgtaatagcgaaacagattgtagtgtagaccggtttcgctgtccgcatactggcccgcataacgcagcggctgatggggcagggcagactgtttcgccagccgggtaaagccctctgtctgccggcgcacttcaccaaaactgccgtactggccgctccagcggatgtcgccgcgttcatcggttacctccagcggtgccccattgagatcggtattgaaccacaatacatcgccccgaccgccgtctgccatatggtcgatgcgcgccagcgggctccaggcctcgttgggatcatacacataggtctggcactggccgttatcctgctgctcctgtaacagacgatagccctgccagaggaaacgggtttctttgcgatcgtgccggcttctgactactttgcgggtgcgtctgcccagcgcatcgtaatgatagtgtgcggtaaattcgccgtccggaccattgcctttggcggtgatgagccggttttcggcatcataggtaaaatgctgctcatgcaggccgctacggcgacggaccaggttgccccagccgtcatatttcataaacagattctgccagtgatgcagccggttgtcggtaaccggcaacgcgtgcagtgcatcgtcgtttgccgccaggttgtccgcgttatcgtaagcaaaatgcgacgtgctgtggccctgtctggcttcatagtgcttcagcaggcggccttcatcatcgtaaccatagataatgtcgccgcgcagcgtatcactgacagactccagttcactgcgtgccgaatagcggaaagcgcgttccagaatggctttttccggtaggagcacctcgctatgcaattcactgcgctgcatcgtgcgcctgccaaggctgtcgtactggcgcgcctgctcccttgcgccctgactgcggcgaatttcccggtgcaggcggtcgcgggtaaattcactgaccagttgctgattaaagcggatggcgctgacatggccagagccataatgcagctaggcaagctgctgttcccccggcagggtcagatgggtgaggttgccgagggcatcccattcgtaatccagttttccgtttataccggattcggataataactggcctgctgcgtcataggtgaaggcgatttcatcctcttcgataccgagtgcgatcccctctgcggtcgggatacgaaccaggccggcgagctgtccgctccggtggcggcgatagtggtattcggcatgctgcgtcgtgcgtccggtcatcaggccgctgtcgtcgtagcgaaagtgctgccagcgacgggctgcgccaccatcgagagcgggcttgccgttttcctgtaaaccgctgagaaaaccctgcgcgttccattccagattacgcgaggttttatcgggtcggatttcactcaatggacgaccgagcggatcgcaggtaaatcggtattcaccgccgttgccgttttccagacggagcacattgccacgtgcatcataatgccagcgacgtgtgcgaccaatccggtctgtcaggctcaccggtaaacccagcgcgttataggtccagcgcacctcggcttccagcggatcgcgccacgcgctgagctgcccctggtgattccagtgcagggtttcacggctgccgtccggatgaatgatggcgcacagttgcccactgtcattccattcgcgcgctgtaacatggccttcagcatctacgctgcggataagctgaccaaatcggtcatagctgaacgtcgttacgctgccggagcagtcggtacgccgtgtcagcagcccttgccggttccattccagctttaccacgccgcccgttgcatcgatgatgctgtctggcagcacttctgtgtcatcaggatagtgataggtggtgatgttattgagcgcatcagtttcactgagcaggcgaacgttaagatcgtaagccgcctgggtagcagtaagatcgggataatcggtacggaggatacgatcggtcatgcggaaccagtgccgggtggttcgtcgtccaaccgggtcgatctcctgcgtcatgcgaccatagcggtcccagttgctgcagcgcatagccccgccgggcataatgacatcgcacagctcgcccgcgcgataaaccagcattgtctggcgaccatcgaaatcggtaaagcgggcgacgttatcgtcatcgtcgatcaaccagtgcgcctcaacgccgtcatcacgccgcgcgcgtcgggtgccattatcaaaatcgtactcaaaatccagctgctcgccgccgctgtgacggaaggccaccacacggggcaaaccatcaattgtctgccagcgatactcactcagcaggccgtttgtatcttcatgagcgaccatcaggccgtcgcgccactggaagcgtcgacgcacgctaccgccccggcccgttaccgtaacgagctggcccatatcgtcataagcgtaactgaccagacaaatttcgtcatccagccaggctccgctaagcctgttatcggcatagcgacataccacgcgctgactggcgctgtctgtcagcgcgttcaacgtatgatcggggttccagtcaaaggttatctggttgccgcaggggtcggtgaggcaaaggggaagagaggggccgtcgtcgggcaatggcataaaatgccagcgctcgccgctgatgtcatacagcgaccagctgtcgtcacggtgatgttccagccagcgtttttccgcttcgcagtaagtccgctgtccctttggtacccgagggaaagagacgtaatcgccggagggcgcgcgccagaccagtccatcctgatagcgctccagccgggtttcccagaacaggttccagccacggcccaatatgctgtcgccgggattaccgctgcgccagtaacgctgccagctaacgggcagccgggaagggagcacaaaatccagctcatcgtcgccgctgagaaatttctggccgctgacaatatccaccggacgggcaacaatacctgcggccgccacaccggtcatcaaggcaccagcacggcaggccactcgggcgattttgttgatgccgggaatcttgctcagtaatttacccagcgccccgactttgccagccgcaccgcccacgccaccggccaggccggcaaacagcagagtgaggtccgatgctttataggcccattcaggcacttcaggcttgatggggagcgtttgctcaggttcgccgccgatgtagacgttgtcagagcccgtcatcacttttgcatcgcaggtggtgcgatcgtcgatacgtgctgcaggcaggccgttgatataaacccgggaggaaccttccgccatctgctgcggaccatcgtccgagcaggccactatgctgttggtggccatagcggcaggtttactgttaacaaacacgttgggtgagccggtagtaatcgtgccttttttggtgatgctggccgcgccagcatccgctatcccatcccgggcggcggtagccagttctccggtgagataacccacgccgatgctgagcccaaccaacaatacgccaacgccgagacaggatgcgcctaggccggcgaccatcaatgcacccgccgcaataccgcctgccgcagcgatcaatccaccgacgagggtacccgcaatcatgcctgccagcgcatgagagtgaccgatatcatcgccgaggcgtgcagcttcaaacatgatgattgcccttgtcgttaagcgttaaagcgaaaacttttaagcagcgtttgaaactgtgcctgatcagcgtcactgatggcggacatggaggtcatggtaaagaccagcactttgtgattatccggcgtgaagaccgactgctgttgccaggtgcgtttgccgtcacgcaaaaaattagcgtgcacgcattcgcctttaagcagatcgtcacccagtacggcagggccgcgttcagtctgtttccatcccttaatgtgtttttgcatcagcgttaactgacgatcgatgtacgcaggcagcgcttcaccgtcggcgagcgtatcgcgtgagagagtaaaagcgggggcgttggcagcagaagcggtgaaagcattaaccgtgcggtcctgataatcctcaggcagtgtgatttgaccttccgtaaacagacaagcgatgtttgagcctgacatcgtacacattccttatccttaagatgtgctcaagtttgtcatgaaaagcggggaatctccagcaaaggcaagggcgggaagagggcctggctggaatgtcagaataatccttatcggcaaagggataatggcctcaaggcgaggccattatgggttacctgtgcggaccgccgccaggaccgccaccgccacctggtcccatctgtcccgggccgccgccgggtccccagtatggccagatgcagcccgacagggcagaaacacttgctaacgcgataacgaacagaatcacttttttcatacgggctcctgattgatgtgaatgactctatcaggccctgcctgtacaagtatgtggcggatgaaaaaggctcggcaggataacgtaaaagtttcgttaacctacgtgtgcggggcgcagaccgacagccaacttgttttatctgcctgtgttgcgggctttaccttatgaaggtcagggcaagctgttagcggtgttgcccatcatcttaaaagcagaccacggcgtgtattaccgcaggccgcccttatttgtcccggtgcacatatttgtctcggtgcacaaaacagatgcgcccgtgaggcggagtaacgcaatccagggttcaccccggcgtcacatttgagcggtgacgtgcttctttgcatcagaagtgtgcaccgctacgcggttttagtcgtgaaccgaccgcagactggcatggcacaaaccctcgcccctggcccacaaattgcaatggtcgtggtacgaagtcacattatcacttagcaaaaaaggaatcagacgaatgtccgtgagccgtttatatgttgcccgcctgtgtttacctgcaatttttacgagtttgtcgttctcttcggtggcctttggggcaaatgtacccaatggcgttgcgctggcccctgtgcaggagatcgtgcggggcaacggtgatgagccttcaactctggatgtcgataaagccgaaaccaatgatgcttttgctgtgattaacgatctgtttgaagggttggtgcggacagatcctgagggcaaaatcatgccaggactggcgagttcgtgggaaacgaccgacaacaaagtgtggacctttcatcttcgccctgagctgacatggtcagacggatcgcctctcaccgccgaagatgtcgtcttcagctggcgtcgtctgaccgatccaaaaaccgcttcgccttatgcgtcttttgctaactatgcgcacatccttaatgccgatgcggtaacgggcggtaaaagcccgtctgacagcctgggcgtaaaagcgttagacgctcacaccgtgcaggttaccctggatcaaccggtatcctattttctgcagtttgttgcgcatccttccctgttcccggtcagcgaaaacaatattaaaaagtttggcgatgcctggatcagaccgggcaacatggtcagcagcggggcgtataaactggatcagtgggtggtaaatgaaaaaattacgctgacccgtaacgatcgttactgggataatgcccataccgtaattaaccgggtgacgtttttacccattcacgacgtttcagccgagcttaaccgctacctggctggcggtattacgattacggagaatattcccgccattgattttgcgcggatgaaaaaagagcggcccaaagaggttcacagcacggctgtttatagcgtgttctactttcaaattaatacgcataaaccgccctttaccgatgctcgcgtgcgtcaggcgctggatttggcactggataaaggcatcatcgccgataaagtcattggcatgggacataaagcggcttataccgttctccctctgtccatgggggaggtcacgctgtcgccgcctgagtgggccggctggacgcaggcgcaacgggtaaaaaaagcgcaggtgctgctcaatgaagccggtttttccgccagtcatcctctgagttttactctgctctacaacaccaatcaggataaccaacgtatcgctattgccgcggcctccatgtggggtaaaacattaggtgcaaaggtcactctgcaaaaccaggaatggaaaaccatgttagataccatgcatcagcgacaatatgatctggtgcgctatacctggattggtgactacagtgagccctctacctttttaaataccttccgcagtggcgacagccaaaatagctcaggctatgccagcacagggtttgatgcggccgtaaaagccgcggggatggataccgatccccatgctgtaacccaggactaccagaaagccagcgacattatcgcgaaagatacgccggtcataccggttttctatggtgcgctcaacaagttggtcaatccaaaggtcggcggttatgcaccctcacacctggggttctactacaccaaggacctttatcttgttaagtaaggctggtcgctgctcgcccttatccggacggcgcttttaactcatcaggggccagattctggcccctgatcgcctggtgcaatctccggcctttcctgtcagcgacggaaaacgccctttcaccacgcagtcaacgcacattttcgcccagctaaatcccaccgattgaaactcgcttgcaaaaggtaacgactggaaatgttcttctgttttaaaactgcatgcggaaatgggatgttatgcgctgaggtaaatcaatgatccgatccaccttgaataaactgcacgtataaaacatctgtgaccgggtgccttgcccagtaatatccccacgcacttatttgaaggtaaaaaatggaaaagccattttttaagaagcagatagttgactcttccagcgctgagtgcggtgaaacgctgtccccttgggtgcttttactccggcgaaactgggtgtcttttgtactgggaagtatgaccgtgatctgcttcgtgcaaagccaccctctgcacgcgcggctggcggcagcaacgcatgccacgctaccacgaccgcctacttccagcgcagcttcagatgccacgctgagccagcgccaggctgcgctcaccacagcttcacttgagcttgcctctgcccaggctaaactggcggcggaaaagattcggctggtcagtgcgcagctaaagcttgaacagagcagcctgcttcaggacatcgatcatacccaacaactcgcgtttcagcaggtcagcgacagccgtttccagcaagccatgctgaatggtcaacttgcacagctggcagagcaaattaaaattgaatcggcgcaaatcggtatggctcaaaagctggtcaacaaatggcggccgttgttagcaaaggggtacatctccacgcttcagtttgagcaggagcaatcgaccgtatggggttatgagagccagtaccgtgcgctgttacagcagcagtatggtgcccgccagcagttaagcgtattgaacgatcaacagcttcaaatacccctggcgaccgccgttaagctcaacgttatgcgccgccagctggcgcaggtggatgagagcctttcacaaaatgaaagcaccctgcagcaggcgctttatacgccttctgaggattcggtaaaatccattcccgcgaaagcggacgcgggtgaatccggcaattcgcaaaacactatcactggattaacatccggtaagcccgtcgttgtaacgcccagggagaatcatgccgaaccgcattttcaaagagtaaatgcccaggccggtaataccttcagcagtgagcatcattcggtctcagcgcataatgtgtaatccggttcaggctggtggctgacgcacaggggaagaatatgtatttacaccatcagcccgggcaggatagcctcatttctcacttccctttcaggcgaatcgtaaaatgcccgattactgtttctatcaaaaaggtcagcacatcgttgttctggaaagaaatgatgcggacggcgcttatctgctggaagaaaagggctatgaaaaacaatttgaagaggtgagtgcgattaacagcaatcaggcgcttaaccgctttgctgatattcgccggagtaatcgccatgaccattacgactttttctcgggcgctatcgctatgccactgatgggcgtgctaaccgcaattgctgtttttctgttacggaaaaaatagtcaggacgtcgatagcgctgggcggtgatggcatgacatcccgttttgtttttttgcctgctctgggttaacccccgctcgctgtcctgaacccgtgcgtttaaaaccacgccttgcttacccgctcctgttccaccggcactgctgtctgataacggtcatgatcgcgcggtatcctgaagatggggagccataaagagcgttgtggcctcacgtcataacatcgcctgtggtcatgccagtccagacattaaaacgccacagataagcgttcacgatcatgcgcgggagcctaaatcatgtcagaagtgctggagcaggaagggtggaaagagaatgccatcggtgaaaagtttaacgctaaaggtgaggtactgcctttcagaggaaacacgctgatttgtcatctggcccaggacagtgagatggtcggtgtaactggcgaaatggtggacgcgatgaaagccgcaggattgggtcgctgttatgcgtttctgccgccgtcgagctatcacatgacggtgtttaatggtgccaacgatcgggcacggtatcatccggcctggccacaagatctgaatcttgatgtttcgatggatgagtgcgatcggctgtttgccgcaaaactggcagatttcaggctaacatcttctttacctttgcagatgcgcattggcggaattgcgctaaagcaaggtgtttccctgtcgctggcacccctggactgggcggaaaatagcaaaatacgttcactccggaacgcgctcagcagcacactacactgcagacgaagcaatcacgatgtctacgagtttcatatcagcgtgtcctacctcatccacaaaccggtcgatgaggagctctgcctgctgcagatgttaagagcaacgtatctggaaaaactgatgcgggtttccccggttattaagctgggcgcgcctgagttttgtacgttccgggatatgttgggttacaggccgttgttgaggctggaataatcaaaatttcttttagctgctaagaggctaatattgcggcgcagcactgattaaatcggcgtgaaaattatataaaatgatttttttatagattatttaaaaggcttaagtttaaaaaaattccgcgagtcgcctcaataagacagctcgcggaatatattaatttgaaactttatctgcttgtatggttgcactacctgtattgtcaacgcagttatcgtctgtcacaaacgccataaaggttgcggtagtaggcacgttgacggtgatgggcgcgctaccaacggtggtgccccagcgagcattacctaaaccgccttgtaaatagacggagctgatttggcagccatcgcttaatgaaccatttgcacaactcatgttatttgagagcaaggacatagtataggtacccggttgcaactgaaactgtaatgcggtacctgattgcaccctgacgttacttaatggcgggtagatgcagtgatcttttgcattaattgtaaatgatgcagcctggctgccaaaagaaaatagggataatagtaataaggcattaattttggttttcatacaaaatatccttgtttcaatgtcaggtgaagttttatgaagccaacacggttttcaattttctgataatgatcttcgtaaataatgtggatgattttttctattaagcctctctggtttagtgaggagtaagagtgactctaactgtttccgttcgagagcgtgaatgagcaatgcttacgtacgtaccaccaggcttaacggtcaattgatctgagggaatcgagagaaatgcgtgagcataaggtaaagagaagggtaaaagctggggctgctaataaggcttaagctcaacacagggaaggtggcccgtctcactacattttattcgccattaggcgaatgccggggccggctattcagtatataagctatgaattccgtcacggtgatgacagcctccaggagcattgttttactatttgttgtatcagaccgattcacacatcagaccggatagcgtgcggctaaacatacgcgttaaagggccaggcgcagctaagttgaattctcgttagcgggcatatcttttcatagcgatatgcccgtatccgaaagcttatgtaaacgcagtacaaagcatgaagcggtcaaccagaaattgcacggcaaaatgactgtctgtatcgcaaacactgtgctcaaagttcaacatacgccagccgtttccgcgagcgcgagggcgtttcaacgattgcactggcaatggccgccccgatatcggcacagaccgtcagcccctgcacaaagggctggtcatgcatcaaatagggcaatgcggcaaaggcgatgcgtccccgggcggaagcgggagacagcaaggtataatcatcacccacatcaggaatctcatcgccgcagcgctggatctgctgtttcagtgtggcaaatggcagatctttagttttgagcgccttctgtcctcgcgcatcaataaacacgtcaaacgtgagctgttgctccccggtaacgatgcgcgttttcgtctgctgcctttgcagttcatactcttcgccgagtgcaaggatgctgataatgccggcctcgcgtagtgccagcaaccgacggatcgactgtgaaggaatcgccgcgtagttatcgataaacactttggcgaggccgcctgaaaagcgtttactgtcactttcgttaagaaagggaacgatttcctcaaccacttcgtgcaaccgcagaatggtatagcgccacggcacggttcgcctgtcgcgtttattgcgttcaacttcattcagattggtgctggcccagtggaaagggtcctgcttctgtcggttggcaaaccaggcttccggaaaacggtcgacatcaagcgttttcaacgcaatcgcttcactccacgcaggtgccgcctcttcaagctctttcaccatcagcgcaaacacccgatcgagcaatccctctgcgcccgcagcaatcgcgtcgtcgatggcgctctctgttaccacgttcagcggctcatagggaatcgggcaatagaagtcggcctccggcagaatgcccgaacgggacatcaggacgatcttcagcgcctcatggcctttatccagcgtaaaggtgatctcttcatcatcggcttccacaaactcaccatgctggatcgccacggccatggcggcatcaatgccgctcagcgaggtgcccataatgccgacatcacaggccggtattctggcctccatcaggccagaccaggggctggggaaataggtgcgggtagacgcactgtcgtccggccagacgtgacctgtcgcgatcaccacctgatcaaaggtttcaggtgagtcttcgccctgcgtccagagttttacccctgcatcggtcgcctcaagatcggtgacctgacaacgctcatggatttttacctcaaagccttgctctgtggcgcgggaaaccagtgtcagaaactggtcgcggaaatactcgccaagcaggatacgcggcagaaactggcgaatatgcagagcgccgggatcgacattatatcgcctgagatggctgtcactctgggcgcgcagccagtcgatataggtcataaacaccgggggaatttcgatactggcgatgtttgccagcatcatccgggagttctcttcatcgctgtaaggcatgccgacgccggcctcgtcgccttgttcataaacggaaatggcaagcggcacgttatggcccagaagtgaataaaacgtgtaaatgccggttggcccggcgccgattatcgcgatctttttcatcgatgttcgcaccttgttattgttatggggttcggtcacaggctgtgttttgcgcatgctgcaggaaaggcgacgcattcatgcacgtttttctcctcgccggtatcatcaagtttactcgactattccagaactgcgcgggctaaggataggcgtgaaaactaagcgcagcggctgtcaggcaccgagcgtggcaagttggacgaagagaaaaggtaagctgaaattaaggtgggaaagaaaaaaccggctcagggccggattttcttaagactgcggttggcctaccggccctttgcctaatggcccgccgggaacggattgtccgcttggcgcgtgaggacgaccatcattacctatggcgccgctttcctgctggcaacctgacatgacgagcaggctggagatgatgaataaaccggcaaatacgcttttcatggctttcctcttgagcattaaagggacaataaaatgacctcttaagcctggtttgtatttccgcgaagtcaatgcggcgatggctgtctgtgttgaagatggcaaacgcaggccgcatcgcgaatcccgcattacagcgttcgaggatgtcggcagcagaatcagggctcaggcaaaggaaggacgggaaaatcagcctgatttcgcgcgccgcttagttcaaccgttgaatctgctcagcctcacccgaatagcgggtcagattgccttagcacggcgatgatccggtatgaaaaatggcactgcgaggaggatacagaaaatatgcgccatggcgtgcggcagaagggttatgtaaggatcagttaagacgcgaccaggctgtccgccagcacgttaaggttaaccagacggcaccgcgttgtccgttttaagccaggagaaaaaatgcctgatgactcatcggctatttgatgtgggtgaactgactatgctcagttaatagggttcagaccattattttcaagccattcagggcgaagaatacccatcgccacgcgatcggagcgcttattatcacgataaacggcctgcctgatcacgccttctttaacaaacccattcctttcataaagactcagcgcatgagcattacaggaaatgacttccagactcagacgatgcaaattgagttccataaaggcatagcgcatgattaatttcaggccttcatcaccaaaaccctgtccgcgatcttttgcctgtccaatacccattgccaggcttgcctgctgattattccattcaatactgtgcaatgtgacaaatccaatcaggcggtcatcggcctttgttctgatatgaaaataaaaatcgttgtcagcgggaagcatgattttggccagtttctctgcagaaagcggaaaagcaggctctgtgtctacgcaacgaagatagacatcgtcctgataccacaatgccatggtgtcgatatcttccgctctgggtgcgcaaattcgaatacgcgctgtcgaaaaaagcctgttttccatcgggtagtcgccgcttatttcaggatgtcagcactatatcattgggcgatcgtttaaaaataaacgtttcggctttaagaaggacatcaatcctgcctgtcggcagccgggaaatgccgggtattacataaccggcgggagccataatgtcatggactaagcaaacgcacgttactgcaaaaagcgtgtaaaattcagcgggagtattaaggctgtcatcaatgaggggataacatgatgccgcctcacttcacgcttatcaggagaatgtattggaactgtgtcatcatcttgaaagcatttacgcggcacgatcccgccaaacgctgacccaatggcagggcgcgaatgcgtcttcggcgtgtacggcaacgaaatctttttacccggaacatttatacgcactgaccagcggcatccagcctgcactgaatccggcaataatcgcattactccacgagctgggcgcactgactgcaggagatcccagggcggataatatgcatccagataatttccatgtgacctttcttcccgtcacgcctgcacagtatcagcgccgtgaagcgatgcctgctacgctaagcctggaaaaagccttcaatcaaagcgttaagcatcgccacctgcaggtcgatatgctgcggctggtggcgcttcctgaccagttattgctggcgggcgtacccgatgagctcgccgtgacagaaagggcgctgttttgggaaacattaatgtcgggagaatggcgtgaaccgctacaagaaaggcatgcgggaaaaagcagcccgccagtgttctggcacaccaccttgctgcgttatcaggccgcgaccttaccagccagcctgcgcgcgttttttattgccaaccagcatcagtgctacggttcggtgcggggcacaatcagactggccgcaacgacctataactggtcagatgtaaattttttaactgattgaaataaaatgcaaaaaacacaggccgcgtcttagcgcgatctccgtcacacttatattcgcctcagtaggatagtccatatcctggacgaatttcccctcatccttctttgccaccgctttatatcctgtatggacattgcatgctgtataagcggagcttaatgatgtctcatgtaaatactttgaatattaatagccaacaccagcaaaaagttcggcgtatgaacctgtttatctccatatcggcggcgctggccggattgctttttggcctggatatcggcgttatctcgggcgcactgccctttatcactcagcacttccgtttaagcagtcatgagcaggaatgggtggtgagcagcatgatgctgggggcggctattggtgccatctgcaacggttgggtgtcacacagcctgggcagaaaatacagtctgatggccggggccgtgctgtttattctgggatcgcttggctctgcctttgccaccagtgtggaagcgctgctgggctttcgggtattactgggggttgcggtgggcgtggcgtcttataccgcaccgttatatctgtccgagatggccacggagaacgtgcggggaaaaatgatcagcctttatcagctgatgattacctttggcattgtgctggctttcctgtccgataccgcgttcagctacagtggcaactggcgcgccatgctgggcgtgctggccttaccggcggttatcctgttcattatggttatcttcctgcctaacagtccgcgctggctggcggcaaaaggcctgcatgtggaggcagaggaagtgctgcggatgctgcgggatacctcagaaaaggcccgccaggagctgaatgaaatacgtgaaagcctgcgcatgaagcagggcggctttgcattattcaaacgtaatcccaacgtcagacgggcggtattcctggggatgttgttacagggcatgcagcagtttaccggcatgaacatcatcatgtattacgcgccgcagatttttaaaatggcgggctttaaaagtacccaggagcaaatgattgccacggtcgtggtcggcctgacgtttatgtttgccacttttattgccgtgtttacggtggacagagcaggcagaaaacccgtcctgaaaatcggcttttccgtcatggcgtttgccaccctggtactgggttattgcctgatgaaagcggggcagggtgagatcagcagcgggttatcctgggtttccgttggtatgaccatgctgtgtattggcggatatgccatgagcgcagcgcctgtcgtctggattctgtgttctgaaattcagccgctcaaatgccgtgactttggtatcacctgctcgaccaccacgaactgggtagcgaatatgattatcggcgcgacctttctgtcgctgttgggcagtatcggcgcggcgggcaccttctggctgtataccgggtttaacctgctgtttattgttatcacggtttacctggtgccggaaaccaagaatgtgaccctggagcggattgagaagaatttgatggcgggtgagaagctgcgggatttgggacgctagcacccactattgaggtatccacatctgtctgtttcttaacagctcggcacaggtcactgctgctgggttgttagctgttcctgccaaagcgttattgttcatattctccacaggcagcggtcatacaccgcgttattgaggcatgtgctatttctttcacgcttcccctttcgttcacctgacataaaaagaaggggattctttacagcatgtcctaaacctgagcatgaaaaatttctgaatgccatccaggctggaagggaatacttttcctttcaaagcgctgcaatggtgcgcgtactcctttacggtccaggctggctttaaccgggaaaacatcctaataacaatgttgccatctattaattaagatgttctatttatgttaattaaattaccttgaataacttaagttaaaatgactggtttttctgtctaatggcttggttgttgtttgtattttgagttatttgcgatattttactctattttaagtgttttttgtggtgctattgatctgttgctgttgcatccaaaataaaacaataaatgaatatctcgttattcagtgtttccttcggttaggtgacaatttcattgggcacaggattaatattctctgcgttcagaagcacattgttctcttctgcaaccacgcttctttattaagcgtatgagcggcgaatgcgtttgacgcattataaaaaatctaagtttaagggattgttgtaatgaaattgaataaagcggttaaatcaatcggtctgtgtgcagtgatggttgcatttggcgctagtgctgccgatcaaggtaatggtgaaattaatttcaaaggttcaattattgatgcgccttgttcaattgcggctgaatctgcaaaccagactattgatttaggtgaagtaacaaatgctgcattgaaaaacggtggaaaatctgcaccgaaagcattcaatattaaacttgaacaatgcgacacggcaacctcaagcagcgtaacagcaaccttcacgggggcagcatctgcaggtaacaaagatctgctgggtattaccggtaccgcaagtggcgcatcaatcgctattactaacggtgcaggtcaaatcatcaaactgggtgaagcatcacctgctcagaatattcaggacggcgtgaactcactggcgttctcagcttacctgcagggtgacgttgcttctggtactgaaggtaaagccgcgaccatcgttcccggtgacttcacttctgtagcgaactttactctggcttataaataaggcagtaagcgagcgttaatattttcattaacattcgtctgcatgagcagagtgatctgctcatgctgttccttgaagggaatactttctatgaagataaagtcgcagacttatttttggatgctgcctttcatactgacattctgtgcacctgaatatggaatatgttttacacaggatcacgcacatggcgttgtcggtatgcaaggcagtatcctcgacgcaccttgtgctatagccgttaatgacagagagcagctcgtcgatattcctgcattaacgacaggcgagctgatccacgatggtgctggttttgtcaggaatttttcaattcaccttattaattgttctgtttcagatgccagtacgccaggaggagacaaaagtcattttatagtgacatttgacggattacctgacggaaagttatttggcgttaatggtgttaccgggataggaattgaaattcaggatatggcaggcaattttgctgttcccggtgaacccatgccggcaggccagctaaccaaagggcggcaaacactcaattatcaaatgaggttagttggcgatgcgcaccctatgcattctgggaaatttcatgctgtagtgcgtttcaaagttgattattactgagtttttttcgacgattaatatcatgagaaaacaaaattataaaaatagcacgctcaggctatctctttgtcctgtcgccctggccgttttagctgtccttttttcacctggttatgtgatggcagaaaatgatgatgttgaatttaatatcgatgtgctggatgttaaggaacgtggtgaggtagatattaatcggttttctcgtgcaggttatttaatgccaggtgattatctgtttaatgtggttgccaatagatcagagtttcctgaagaaaaaatcaattatattgctcctgaaaataaacctgatgattcactggcttgtttatcacctgatttagtcagtcggtttggctttaaagagaatgaattaaaaaaagcacactggtggcacaatgaacaatgcctcgatgtcagctcgtttccaggaatgactgtcaggccagatctgggtaccggagtattaaaaataagtatccctcaggcgttgttggaatatacatctgaaagctgggatcccccttcacgctgggatgatggcgtacccggttttattcttgactactatttaaacgccagacatacccagtcaagaaccagttccgatgcgcagtctttgagtggaaatggagtgacgggattaaacgtgggcgcctggcgcttacgtgcaaactggcagggcgattatgatcgtcaatctggtgtaactggcaccacaaagaaaaatttcaagtgggaccggttttatctctttcgcgccataaagtcgcttaaatctgaactgatggtaggcgaagcctatttaccctcaacgttatttgacgcgtttcgttttaccggtgccagcttaacatctgatgatgcgcaacttgcacccaacctaaggggttatgcccctgaagtggtcggtgttgctaaaaccaatgccaaagtaaccgtgagtcaacagggcagcgtcatttatgaaacgacggtagcatccggacctttccgtattcaggatctgaacaatgcggtaatgggaaagctggatgtcactattcaggagcaggacggcactaaacgtacgtttcaggttgatacagcaaccataccttacctgacgcggcccggcagcgtccgctataagctggcattgggtaagccttcagattacgaccaccatacacaagatattaattttataacgggtgaagtgtcatgggggatttcaaacgggtggtctgtttatggtggtgggctttttgccgatgactatctgagcattgcggcgggtatgggacgagatttgctcgcttttggcgcaatctcgctggatgttacctcagccaaagcaacattaagtgaaagcgttacccgaaaaggtaattcataccgtgtgagttactccaaacgctttgatgattacgacagccaaattacgtttgcaggttatcgcttttctgaccgtaactatatgacgatgtcacagtttttaagtgctaaaacgtcaacttatagcaatcctgggaacggaaaagagttatataccatcacggtggcaaagcaactcagaaagctcaatacagggatatatctgagctataaccaccagacttattgggagcgggcggcgacgaatacgtggaatctttcgctttcgagcagtttcgatatggggcggtttaaaaatgccagcgtgagccttaccggatatcgcacgcaatacgatcacacgaaagatgacggtgtttacctgagtttgtcactgcctttcggcgaaggaacactctcttatagcggtcaaacctccggtggaacgcaaagccagagcgtgggctggcgtgacaacattggtgagaatggtaactacgatatcgatgtcggtacctcttcagatggcgaacattcgattaatggctattacgattacaatggcagtctggctgacatgacggtttctgccggatttgaaaataacggatatcgctctttagggctctctttagaaggtggaatgacagcaacctcacagggggctgcgctgcaccgttcatctggagcggatggtacccgactgatggtagacacggcgggagttagcggtgtcgccgtatcggatggcggaagcgatattaaaactaactattttggtaaggcagtcgtgactgacgtaaatagttattaccgcagtaacgtcaatattgatttggatgaattgcctgatgatgtcgaagcaacgcgttctgttgtcgaagatacgctgactaaaggcgctattggatatcgtaaatttggtattttagccggacaaaaaggcatggcgatcgttaagcttcaacaaggttcagtgccgccttttggtgcgatggtgaggaatgcagataaaatacagacgggtattattgctgaagatggaaaagtctggctatcgggtatgaaaccgggtgaaaaaatgaatgtaagctggggagggaaagaacaatgttcttttactttacctgaaagcttacatgaggatagaggtagcctgttacttccctgcgttgaaaattaattaataacagaaaaaacgaaaagcgatgaccggtttttctttttatcttttgcaacaccactttcattatattacaagattagaggttgatatgtttacgataaatagagctttttttctgagtttgatgacattaatgatggctgcgactgttcctgctgcgaatgcagcggttggtctggaccggacgcgtctgattatcaatggcgaccaaaaatctgaaacattaaccgtcaccaatcataataaagaggcgccttatcttgcccagtcatgggttgaagatgaatccggtaaaaagctcgaaaatgaatttattgcattaccgccattacaacgtatagagcctaattccaaaggacaaataaaagtacaagtaatggggaaggattcacatgcccaggacagagagtccctgtattattttaatgttcgggaaattccacccaaaagtaaaaaaccaaatacgctacaaattgcattacaaacccgtataaaaatgttttatcgccccgcagggcttaagttagccagcggggatgttccccagacggcattgacattaacccgtgagggggatcgttaccgtattactaacccaacgggttactatgtcaccatcgtgaatatgagttctacgactcaggggaacagtaacgagtttaagtcagtaatggtcgccccaaaaagcagtgagttggctgaggtgagcgcggcaagtctgggaacgaaaccggtactgacttacattaatgactggggcggtcgtccaaaactcatatttagctgctcgggtaatgcatgcaaggttaccgataaaaaagcagggtgaatattttgttcatcgttctcctgaagcatctaaacaataaagtattatcgtgctactacacaatgtgcctcatggctgtttcgtgtttagtcagcgctgcacctgcagtgcaggatacctggcaaatggacggagaacatggccagatcgttgtgaatggtttgctaagtgaaggtgcgtgccgtctggatcttaattcagccttacaacaaatcgacttgggcatactcaatcctgccgaccttatcgagccaggaagtgaaacgatacccgtccggtttagcattcggcttactgattgttaccgatcgtataaagatcagtctgtaatgccgggaagaaacaatctgttttcctatatcgaaccgttggccactgtctcattctcaggattagccgatgacgactatccctctttattgaaggtacagggcgtaaagggcatcgcattaaaggtgagcgataaagatatgaagatggtcccgcttaatcaacagggaagaaagtactttatatcccataagactgagcgttttgactactttgtctcagctgtaaaaacaaagcctcaccttgtgttcggtgaattttgggcagtggccagctttaaggtcgattatgaataacagtttatcatgtcttaattcaatttttttaatgttacttttttatgttttatttttaattttatcgtcagggccagccaaagcaagcgatgggtttgccgacgttgataatattaatgtgtcagggaaactgattgcttctacctgtgacgtgatcaatgctgatgaaaatcacgttgtcgatttctcaaacgttaatgtaagtgatatttatgccaactcacacggtttagcaaaagaatttgttattattgccaaaaactgtcaaccggaaaatgatttgactataaatttcagtggtagagaaaacgaagcacttcccggtttacttaatatatctggtgatgcgcagggtatcggtattggtctgaagtcaggtggtatcaatggtgtgccggtttcagtaaatagtcactcaaacttacccagtgctgtacgcggagaggacattgtctttatattgggtgcctatattaaaggtgagccacaggcggttaaagacaaaaacattgtactcgggaatttttcagcaacagcaaactttatattgaggtatgaatgatgtcagtaacctcttttagaaaggcaggcttgattattctaatactaatttttggctctccgctttgttcttttttctcctttgccggagaaaccttcagagctaatatcaattttgatgggaatattattgccgatcccggaatgtgttattttgatgttgaagggttgaatcccgggcctggtaacttactggaaggctttgtcgaagatgacgatatatacaactataattttggcgaagtcgtttttcgttcatataatgggcgttatgtactggataaaaaataccgtaaaaacttcaatgtcgatttcaactgtaccggggaacttgcacttgaaagccatatgttagtgcggatttatccagtctacggtaccgttgagggacaaaaaaatagcgtgattagaatgttgtctttaccttttctaaagcatattgaatcagtgggcttgcagctattggttaatggaaacccggtgacaacacagcggtcccactggttgcgtgtaggaaaaaaaacaggtatgtcttttcaattaattcagcttgatcctttaggctcagacttaaaagatgacgctattttattttcagttatcaatgtcattgtacaacctaattagcggttaaaaataaaatgaaaaagaagaggcgtgtttttttaattgctatattgatgatgcttcagttttccagcaacagtttcgctttttcaaactcaatgagcgatggcattaatgatggttgccagaatcaggtagatagtgatggtattgtaacggggtcatgtggtttttccgcttttgttgtgatgaagacgaaacttgaaaccgcaccatggtgcattatcaataataatgaatccatgaatgttgtgtttgatgctgttgatccctacaaaatttcatctgggctatataaaaaaacactggaatacgactttatctgctcagatgcgactccgggttataacgttttttttaaattagaaggcattaatgccgcagggtttgaggatgagcaaacaattcagaccagcgttaatgggttaggcatgcaaattctgatggacggtataccaatgaaggttcatgagaaaaaactaattaatatggtttcaccgcctctacttgaagtgcttttagtcagacaaccgactaaaaccctggaaggcgatgagttttctggaacggccagtatgacggtggtttatgattaagcgctataatttgggatttattctgacagtaatgctatttttgttactgggtatatctacttgttctcaggcaaaagtcaaaggtattcccttacctaaaagctgtaccaaaggctcagtacacatgactgacgggttactgggttttggtgactgccatccaaccagcgaagggcttgagtcaggctttttgattggtgatggatggtctatgcctacaggcactagccacgtgactgaattagatggttataaagtctatccgcaatatagtgggaattataatgcagtgatgtttttttgtcagagtacaacggcactaaaatgcactatttcaacggcaaattatcaaatacatactcgtacagttaatcaacttaatacaactaaaactatatcgaaaaccaaacctaattttggtggggcggccaatgcattagagaatcagccttcagcatcattttgtgttgcgttgcaaaatacaaatggcactgacgatgcatattatgttgatcccaaggagccctattcttgtagtgatggtgttccactgcctgttgaagcagcgacgtgttatattaatcgggggaaagatattcaggtccattttggggatattaaaagaacggatctgactgacagccctgaagcgccagcggctatttataaagaaattaatattccgattacgtgtacgcgtgatgcaggaatatcattaaaaatggctattctttttacgtctttagttggacagtatcataccatttcgacgacagctacgggtgtgaatatcattcctttttatgacgggcatttttctcaggatagtgataataatcaaggtgaaagcaccgtttatcaatacggtattcacgaaaaaaacgttcgattttatcttttccgtgacccggatgtaaaagtaaaagatattcctttaggtccatttagcgcgagttctgtaatgattctgacagaagactgattagctccccagtgaggataacgttaatcaattatgtgaagtgatgtgctttataaaaaccgcttatccaactgtttatttttggattttcttagcaatatataaaaggtaaataattgacaaggaattgataacattttcgttgagaaaatgattcagaagaagtggttagattaatgaaatttatctaaatgattttataggtttattatgtttagtgctattgacggaatcaggttacaacctcttgttgcgcttaaaacaggagaggttattgcgcatgagatactgtcaagtatcaggaatcacaatgccgaaaagtggttttctgaactgtctcctgaaaagatattttctttgttcttatggcaggtagagttcgcactcaatatcccgggtaattactggcttaatctaccggttgacgtttttagtgatatggacaaggtaaataaaatactaacgatagagcatgacgaacgtattgttctggaaattcaggaccctgaaagattactcagctatccttacgggaagctcatttcttttgaagagggcatctttttacttagacgcgctgggtggaatatatggcttgatgacattacgtcaaagcttatagcattagttaaaaaagtttcagtgaatgtcaacggcataaaaattgatcgtaaggagataaaaaaaccttttagcattgacaggcttattctacaagcatctactctttccccttacattcttgttgaaggcatagaaacagaagcagaaaagaaaaaaatcatgctcaccgatgcacgatatgggcaaggctttttgtggcctgaagaaaaagtatatatgcgcgtgcccaataaattctgttaaaacctgaaacagaaacagaaacagaaacagaaacagaaacagaaacagaaacagaaacagacaacaatcacctcaccatttttctgttgcgcataaatatgaaacccaaagcacacagacaaatgcataacctgtatgaagatgtgctctttactatgcagatcgtctacggccattgagcgctcgtctgagagagtgttgcgcctgttttgttcgcaaaccacatcaccattaacggtagtctgggtaattaaacatcagcagacaggacagtcgacctgattcgtttgttttttaagcaactctgccgttgtcagtgaaaaattcttttaaaaaaacacataaaaacttacgatacataagaatttttttaggataaagacgatatgaaaaaggcaatcgcagtcattttattagcattcgccctcactggatgtggagagcctaagatcgatggttcttcagaagaggcttttaagacatcgcttcaaaaagttcgagactcactcgcggaagataaacgcgccgcgtttaacgatgcgattcaggttgtcgccttcagccaggtcagcatgaaagagctgatgcaggcgggcagcggtgatgaaggcggacgtgccctgattgataaaaagattaaaggcgcgctggctggcaagaccggtgaagaagtcattgagtatgcagataagattaaaaaagaccgcacggccaactaagctgagcgcgtttttatctcagaccagcctgttgcgtgaggtctgatttaacggttgctgcatgaaagaggcctgttttgcaggcctcttttttatgccactaatctatgtcaggcataatgaaacagtggggcttgttctttactggcgtagtgccacaggtacgcgagtcacgctgcaggggggattttaatggtgacgttgcactggttgaatgcatcgggaagccttgcttcctgtcgagaagggataaaagcgaatatcgatcttgcgatatcacgcatagctacccagcttacgctgcccgatatcgacgttctggtgcaaagaacgacgttcgaggtaattgaggaaatgggcttttcaggcagagcctggggaccgcatctgatgtcattctatcttgatactgacagcccaaatttgcagagcagcctggcgcgttatgacctggctcggcagttcgcgcatgagacgcaccattgcctgcgtatggcgggcacgggatatggttttagtctgggtgaagcgctggttagcgaggggcttgccgggcactttgccagcatgacttttggatcgccgccagaaatatgggagtgcgccgttggcaaggaaagattaaaaaaatctgccgctctctgatgagcttctcaggtcacagtcatacaaccatgctgaatggtttttcgggcagggcgatcacccccaatggctgggatacagtctgggctggcacctggttgatgcgtggttacaagccggtagccgaagtctggatgaaaggattaatgttgaggccgacgatgtattggcgtttttaccaacagtaatcgattagccgctttgcataaaaacgataaatattcccgtatggataaataacgcaaaccttcttctactggctaccgtcattacgatgtcttgcggcaaacaagcgttgcgtgatcccaccacgtattctgattaactgagaaacagctaacgttaaaaccagcggctgctatttccgcggtcaacgcttccagcggtttcaaggtgcgccagggcgtgccgtctttcagtaacagatgctggatgcggtcataacagatatgatcacccaggtgtttgggcaaaccacacatgctgctgataattaaagtcccatcacgggttaatatacggcgcacggctttaaggcaatcactacgctgtgttcccgtcaggcaatgaaagcagctgccatcaaatatcacatcaaactgagcatcttgataccgggaaagatcacatacatcgccccggtcaaaatgaccgaccagacccgcttgactgaaacgttctcgggcccagcggatggcgacgtctgagatatcgaccccgtaaatgacaaacgatctgctggcaaaatagtgggaggccatggcgccattaccacagccaagctcaagaacggttccactgccgggaaggtatggtgtttcttcaagctgatgaagcacctcgtttagctgctgccgagcccgcgtgaagccacttcctgtccaggcttcatagcctccatttttgaggtgctgatagatatcgtcatagctttccacactaacgcaacgcctcctgtcattatcttatggctgttttgactcagcctgcctggatgaatgaatttaacattttgaccacttctcaagcgcctgacgctaaagtgctttacccaggtgaatcgccctgagtactgttactgcctgtctgttcactcactcgctattatgatcctgctcactgctgcttactggataagacgtattcggccgctcgtcggcattttattactgataagtgcggccagccaggcacagtcaggagaccggcgcgtggtgactcagccgcgcctgccgcccgtctgccagcggctaagtgctggctctgatgtcaatgtggcacagctgattcagcaggcgctggatacctgcccaaaaggtaacatggtgatgttacagccttccagccaggccagtgtgttctttagtggaccgttgcaggtgccctcgggcgtgagtctggcgataggtaaaggcgcggtgctaaaagcgattgccgatccacatttatacgataacgggcaccaaacctgtggcgcactggatcgtcagggaaatggatgcgtgccctttattaccctgaagcatgccagagacagcggtatttacggccagggtgtcattgatggtcagggcggcaacctgatgacggggcaatctcagacctggtggcaactggcagccagcgccaaaaacagtgaggataaacaaaatgcgcctcgcctgattcaaatcgatgacagcagcgatatcacgctttatcaaatcaccttgaagaatgcgcctaactttcacgtggtgatcaataacagtcagggcgttactttgtggggcattacgatcgctacgcccgccacggcgcgcaataccgatggcgtagatcccatggggtcgacggatgtttccctgattaacagcgatatcagcacgggcgacgacaacgtggcgattaaggcaggcaacgcgccggctgcgcatatttcggtactgaacaaccatttcggtgccgggcacggcatgtcaattggcagcgagatcaaccgtggcgtcagtgacgtgcgggtggatggactgacgctaaccggcacaaccaatggtctgcggattaaaagcgatcgctcacgcggcggacgagtaagtgccgttcattatcaaaacgtctgcatggataacgttgaaaacccgatagtcatggatacgcattacgatccccacgttagtggttcactcataccaacctatcaggacatcacgtttgagcatattcgtgcgggtaacggaaaaatcaccttgctgggctacagtgacgccttgccgctggtcattgcgttaaaagatgtcttgattggcgcacgcgcccaggtggagcagcaacatgccgttatccacggcgtatttacgcgcaccagccagagcgggtgcccgtaaaacaaggcaggctggcagtggtgatgacatagtcgcccttagctctcgctcgcctcacccagaccgcctaaaaaaattgtcctgccgtttcttcccgaccaccggcgactggcgtaaaatcggcgaaccaaagtggattgtcttgcagagtgggcattatgctaatcagcacggaaaccgaacggacgtatatcgctgacagccgtctcgcctgcacccttgccgccgtggcgggcgcgttaaacaccgcagcatttgaaattgtgggattcttttccgccaatatgaccggcaatgtctcttcgctgtccgattttctggcgaaggcaaacctccacagcggcctctttttcttgtttatcctttgtatgttcattgtgggggcgctcgtttccacaatgattatcaatgccgggcgcagacgcaaaattcgcacgatttacgcggtgaatatcctgatagagggcattgcgttggtggcgctgggcgtgattgaagcccgcttccccattgccgcgtcaggcgtcctgcttatcctgagcctgagttttttaatggggcttcaaaatgcggtcgtcacgcgcatctccaatgcgcgcgtcaggactacgcacgtatccggcacctccacagatatcggtatcgaactcgccatgctgttcgatgtgctacggcgcaaagaatcccccaaagatgcgccgctctatctggagcgcctgcgtctgcatacctataccattcttgcttttctggcgggcggtgtggcgggcatctggctctggcatgcgctgaactactattttctggtgctgatcggtctggggctgatgggcctggcgctggccgccatgctcaagcctcagcctgctgatgtggcccgttaaggatgccggtgttcgggagtcagcaccttaagcgcattattgataaggcgaaagtgggcaggcgtttgcccaataatctcgccatcggcattaatagagtgcggacggcgtgtatgcagcgtcagtgccgtggtgctaaaggcgcgaacgttacgccagcggccatgtgtcccgcgacgcagagcggggaacagcgccagcaaatgccagcttcttttcagttcaaggctgtaaacatccagtagcccgtcatccggtgccgcgctttgctcaacggtcataccgccgccatagaaacggccgttgccaactgaaacctgcacggttttgatcgcgatagcctctccctcatgatgtaaggtcgccctaaagggccggctttgccgcagaatacgcagtgcggcaaaggcatcgcccagaacgccccaacgctttttggcctgggcggtgagattgcgcgccagctccgccgagaaaccaatgctggatacgttcaggaacaggtgatcgtttacctcgcccaggtcaacaaaacgggtctgtccctggctgatgatgctgacagcctgctccagttgaggcggaatcccgagcgtacgggcaaaatcgttggcggtgcccaggggtaaaatgcccagaggtaaaccggtttgcaacaggcctaaagctgcggcatttaatgtgccgtcgcccccgccgacgatcaccagctcaacacgatgggcatacgcgatgataagctcggtgtagctgcggctgtcgtcaggatcgggttgcagcagggtaaaaccggattgctgcagcaactgcgtggcgcgcgtggcatcaatacgacctttacgtgagcgttggttgatcaaaagtaacgctgtctttaccctttgcgacatgcttcgtccattttttgatgaagtaataatgatgaagtaaccagaaagtaaacatgcgggattatccgttacaaccttgcttgcgctactttacgtaagtgcaggacggcagggggaacctgacaaactgggtcgaggttgtctacactgccagaaacggcacgactcatgggagcaacgatgacagaacaacaatttagaagcctgttggcagaaaaaggctttgcagagccggtgatggtagagcggggggcaaacagcgaactggatcaccatgagcatccgtttgaggcaatggcactgatcctgagtggtgatatcaccctgtacacagaaaatcaggctgccacctatcgggaaggcgatgtctttcatctgcaggcagggcagccgcaccgcgagacgtttggtgatcggggtgttcgctatctgtcaggcagaaaaagctgatccggtcgatgagcctgtgatgaagactttcgacgcgctttttcagcgattagcccaatcccctttccgtcagcgcttccgtctggggcggaatgaatatgattactgcctgacaaagggcgaagccgatgtggcggcgcatgcggctgcgtttgttcagcaacgactctctgctatggctccccacaacgacggcaagcaaacgccgatgcgcgggcatccggtttttatcgctcagcatgccacggcgacctgctgtcgtggctgtctggcgaaatggcacggtattgcccagcatcaggcgctggacgataaacaacaggcttacgtggtggcggtgatcatgcactggatacacagggccatgacgcaacctgctccggcaccgcgtgcgcgcaaaaccagggcaaacacaacatcgtgtttgccggacagcccgcaactggacttctggtagaaaaagattatctggctgatggacttttaaccagtcaggttagccatatttcatttcaggtctattcttaaatcgttctttggtctcctgtgccaggataatcacgtaagacgacaaatttcacacaagagggaattacgatgaagaaagcaattattgcactgtctgctgttttactggcctcgccagttttcgctgctaccacaacggatgaaactgtcgctgaagcgcataaaggcgcagataccgcgaaagaaaaactgcatcagactgagcacaaaggcgaagagctgaagctgaagtctgagcacgctgcggaaggtaagagtaactcgacctccagcaaaatctctgaaagcacccagaaaggctggcacaaaacgaaagaaggcaccgagaaaggctgggataaaaccaagcagggtgctgaagacctgaaaaataaagcgactaactaagccgctttactatgaaaaaacccaccgttggtgggtttttttatgacctgtttttattctggctgggccggcagcgttttcggctctgatgacctggcctttgcggcttccgttttagcaactaatgactcagccttcgcggtttctgcatctgccgcgtcctgttgtgcggtatcagactgttttttcccttcttcgataaactcttcatcgatctcttcgatgttttcacggttatcgcgtccggacagcagattccagcaggcaataaacagggcggcaatcaccggaccaatcacaaagccattgatcccatagatttccatgccgcccagcgtcgtaatcaaaatcatgtagtcgggcattttggtgtctttgcctaccagcaacgggcgcaggatgttatccaccaggccgacaatcaccacaaagaagccgacgaggaacaagcctttccacagtgcaccggtggcgaagaagaagatcgtggccggcacccagatgatggcggaaccaacggcaggaaccagtgacaggaagcccatcaatgcaccccacagcagactgccgtcaatgccggtaaaccagaaggccagaccgcccagaatcccctgtaccacgccaacgactaccgtgcctttgacggttgcacgcgatacggcggcaaacttcataaacagatgatgtttaacgtaggtggacagcggtagcgcttccagaatcagatgcaccagataggaaccatccttcagcaggaagaacagcaggtaaagcatgataccgaagccaacggtaaagctgaacgtgcctttaccgatgataaacgcgctgcccgccaggtactgaccacctttaagggcaaatgccgacagcttttgctgaatctgcgtggcattgtccaggttattttcagccaggtagtgtttggcccagcccggtaaatgctgtaacagatcggcgaagacgacagggaactgggcggagttggtctgcagtttgtgataaaccgtgttcacctccactaccatcgatgaggcgatgatcgctaacggggtaaagacgatgaggcagatgcaaaacagcgtcagcagcgcggcaagaccgttacgatcgcccagcttgccacgcaaaaacgttttaagcggatggaagatcacagccagcaccgctgcccacaaaatggcagagaagtagggcgataatacctcgaaaaaggcaacggtagtcattgccaaaatcagaaggaaaaacccgacagtaagtcctttaaagcgcattggataacctcatgtaaacatcccttgataagcacgcatgccgatgcgggcattcgcaacccgagagtgtatgaatgttgcatcggtaatcaacgatcaattctgtttttaatcatcgccagacggcatttctgcggcaaagcgcccgatgccataagcaggccctttaataccacagtcaggtaataccttgttatctgttgataacatctgcccgtcctaccttagcgtagcgggttcggccgtttttgccgccaacgatcggcggtttatttgtggaataaagtaaacccagagtaaacccctggcggaacggctgaaataaaactgtcatacggcaatgctagcgtgaaatccggcaagatcagagataatcagagaccaaaggaataataatgaaaatgaaattcaccctgattgcggtcgcactgctggtggcgcaacaggcacaggcaatgacgttgtccgaggccagtgcactggcgaatcaaacgtcacagggatcgtccagtccggcatttaacgcacttgaattacaggcgctgaccgcagagcgggcggcgatacaaaagggcgcgccagcgctcagtcgcgatcagcttaagcaggctaagcagagtgacagcattgccgactatcagtggctaaaagccagtggttatgatttccagagtgatgcgttgcagaaggcgggcattgcgctgttgtcaggattcagcacgctgccggataaggttctggaggccaatcgggccacggtcacatcaattaacctcaatgcaacccagggcgaacgccatcaggcgctggcagacgcagaaggaatcagctacctctatttccttgccgacgcattgggacctcgtttaggtaaagcctttctggcggcctatgataaaggcgagattaacaaggcggcagccctgatcaaagccagtgaagtcagcaccggtgcggcgaaaaaacactttaactatccgcgtcctttcctgcacacaggcaatacgattcatctggtgccggatgatacggtgatcaaagacaatcatccctatacggccgatggcggttcgttccccagcggacacaccaatacgggttataccgatgcgttgttgttagccgagatggtcccggagcggtttgaagccttactccagcgcggcgcacgctacggctattcgcgactggttctgggtgtgcactatccgctcgatgtaatgggttcacgcatggtggcacaatataacgttgcacattatctgaacgatgccgcttatcgcgcgttattcaatgatgcccgccagcaactgcgcagcgcgctggaaaaagagtgtggaacaaccttagcggcgtgcgcaaaacccgccggtcgtgatgatccctacggcacaggcagcatgaagccgttttatcgcttcacgatgagctataacctgccgaagctggcagacaacaaagccagattcacggtgccggatggcgcagaagtattgctggaaacggcgttgccgcagctgtcggcaaagcagcgacgtgagctgatggtgaaaagtgcgttatccgccggttatccactggctggaccgggggcggaccaggcgttctggcagcgactggatctggacgcggcctatgcacaggctaagtcacactgataaaaaaaacgggcgggacatctcgcccgtctcgctgacagcgtcgcctgggttggcatcatgcctggcaccagaattgtggtggtcgcgggcctgattgccatttctgctattttctattcgctcctcaaggtctgatagtcgacgcttctggcgcgccctcctgtctttagccgaggcggtctcaagctgaggcgagggctcagacgtattcattaaacaaaggtttatatttgttacgaattagcatgttaaagttaacgagaataattcttatttcttaacagggttaacaaacatgaaattcggtatttttgcagcaacgttgctggcgtcagcggtttgctcggcgaccacctatcctctgaccgtaacggatgtggatgggcaaactattacgctgcagaaagagcctcagcacatcattttacaggatgggcgagatatcatggcgctggcgctgctggatcgtaacgatccttttaaacgtgttgtggcatggaacaacctgcccaaaaaacaggacacgcaaacctgggcgcttctgaagaaaacctggccacaggctgaaaacattgtggatatggggttcaacgaccaggggcaggtaaatcttgaaagcgtgctggctaagaagccggacatgatgattgcgcagttacgtgctaaacctgctcttatgcagtctggtgttctgaccacgctcaaaagcctgaatatcccggtcgtgtttgttgactacgaactgcatcctaaagaaaacaccgtgcccgggattactctgctgggtaaagtgctgaaccgcgaagccgaggcgaaggcttacaccgatttttatcagcagcactggcagaagctgcagaagggcattgaccaggtaaaaaccaaacccaccgtctttattgaaccgatagccggtaacagcgacagttgctgctttacccatagccatagcggttggggtggactggttgaagcggtaggcggcaaaaatatcggatcagcgttgctgccgggtaacgctggctttgtttccctggaaaaaatcatcgccatgaaaccggatgtttacatcatgaccggctcaaaacgtccaaacagcaatgtgctgccatttggttacggggcggacaggaaagacgtggcggcaacctttacgactttattaaagcgcaccggcttgtcgcaaatagagccggtcaaacagggacgcacgtacggtatttatcaccacttttataaccatccttacaacattatcgggatggagattctggccaaagatctctacccaaaacagtttagtcagctcgatccggttgcggattaccatcagatcatccggcagtttacaaaattaccggacgcgcctgtgctgttgagttacccgtaattctcatcaaggtcaggcgcgaatgacgcctgaccttgatggcgcagaccacggtcttaaccgctttagcttgtctgtcagtcatctgcactgggttatttttcttaacgataaagcgctttgttaaaaataagcgtgccatttttcatcgaactgtcactaacgaagcgttattatttcatcgcgacactggtgatgtggtgttgtctgctttgcttttccctgatgcatgttaaggggcattttccagttaactggttttaaagacgacttcccgatctgcggatcggggctttattttttattagtttttatgtcacgcctgccctgattcccttaatacccgcagtctgttatgtcatccgtactgtatctctgtttcacgcggtttactgtatgcctgccgaaaggatgaagaccagaccgcgctggtttactggcgctgacttttaagagttttggtgattcttatttttttctgccgagacaatagtagtggtaacggtgcgtaagcgccgttaccactggaggcagtaccatgaaaaaaataaaatctggtttgattatcgcccttttagcatacagcacgatgtacagcagttccgctctggcacaagggccaggcggcccaggtggacccgacgggccgtggcatcaccccggtcgaggtcccgacggcgacggcccgcccggcctcgatcgcgatgggcctcccggccgtcggccaggacctggcggaccgccaccgcccgatgtgcgccgtgattatcacccggatcgttttgcctggcgtggtcatgagttccgccgtggcggcccggctccacgggaatattgtggcgaggattaccgtattgacgactggcgtgagcgcggcctgagagaaccgcctccgggccagcactgggccgacattgacggtaactatgtgctgattgccgccgcaaccggcattattacctcactgatactgaataacgcctttcagtagagacacagggatggcatcggccatcccttttttttgtgcaccctgttgcccgttaccaggctattctgacagtaaattctgaacgttcaccggctaaggagttctgatgaccacggttaagatggtggctgttgatatggatggcacatttctggatgacaaaaaacagtacaaccgctcgcgtttcctcgcctgttaccaccagctcactcagcgaaatatcaaatttgtcgttgccagtggtaaccagtatcaccaactccgatcgttttttcctgaaatcgccagcgagatcgcctttgtggcagaaaacggcgcattaattatcgatcgtgatgaggagctgttctgtggcgcgtttacgcgtgatgacatagatgcggtactggatacgttaaagaatggtcactatcccgacctgcgctatctgctttgcgggcgtgacagcgcctattattttgaaggaatggatgagaagtggctggtcaagatgcgacattattgccatcgcctccgacccattcgttctcttgatgaggttgccggggacaagatacttaagtttgcgcttaatctgtcagacgattatgtcgaacccctgatggcagatattcagcgcctgcatcaaggcgctgcggcggccacctccagcggtcacggttcggtagatttaatcgttcctggtcagcacaaagcaaacggcctgaacctgctggcgcagcgctggggcatttctcacgatcgggtactggcattcggtgacggcggcaacgatctggagatgctggagcagtccggcttcagtttcgccatgagcaatgccccgcagcgggtaaaagagaccgcgcgtttcctggcacctgccaacaatgatgaaggtgtgttacaggtcattgagcagatgctggcaggcgaaccgccttttacgccggcatagtgacgggcaccaggctacaaataccgggagttaactgtgcgggcggtggataagcccgcacaaggactatgcgctaaccggccaggcacgaaccatcatgtcgcgcatttcatctttgctgtaactcaccaggctgtttttactgttagcccgggccagtacccagtcgatgtctgacgggctgagcgctggaccgtcctgccagaaagccgtaatggctgagcgctgtagccaggctttcaggtagtgcgccggagaatcggtgtgcgcgtcaaaaagctgttgatgcatgtcggccatcaactgacactgttgcgggtgctgactgtctgccagatgatccagaaacgtaaagagcagtcttccgcatacttcgccgtggtggaagggcttaatcgcgcccagttcgcccgcaatcccgtgaatgacgcccagccccgcgctgctcaggctgatcccgcccagccaggacgccatcatcatcgcctcacgcgcgcgatcgccagcctcatcttgctggttttgcgcaggccagccctgaatgaactgacgcaatccggtgagggctaactggcgggtgaagaggttgcccttgttggacagataggcttcgaacaggtgggtaaatgcgtcgattccgcaggtagccagcaccttatcgggggcgcctttcagcaagtcgggatcgaggatggcgacctgtggcacaaataccggatgacgcagcgacgctttgatctgaatatcccgctgatccgtaacgacggcgttttgcgtaacttcactgccggtgcccgccgtggtagggaccgcaatcaggggcaatgtgatggcactgaccgccgtatctccgaccttttccagatagcgtgctgtcggtaacggatgctgaatcatggcgctaaaagccttagcggcatccagaacgctgccaccgcccaccgccacgactctgtcaacatgaccacgccagcgcgcgacccaggcatcaatatcgccaggtgaggcttcgttattcacaatctcataaccgacaatatgatcgttgagcgtggatttgagccgggcgtaagcttcaccctgtaaaaatgaacgaccgcaaaagagcagggtagcctggggttgggcagccagcaggggaatcagcttattgaggcttccccggccaaaaaaggtttgttgattgctgtacagctcactcagattctcactcaccagcgcatccttttatatcttcgctaaaatctgagtgtaaccaaaagccggcgatcggccccgcgaaactttcttattccgtagagaggaaaagttgatcgccttcgcaaaacgcaaattcatccacggtggggtgatgctttaacaaggatgttacccttaacatgttatcggtaacaggggttgtcaaaatgttactacttttgcagaaccccggttttacatgtcctcagggaccacgataacaaagcggcactgaaacaattcagggcatcaggtggagaaaaattatgccattactctatgtggcgattggcgtggcattactgttactgctgatgattcgctttaaactcaatggctttatcgcgctgattttagtcgctctggcagttggcgtcatgcagggcatgccggtcaacaaagtgattctttcgattaaaaatggcgtcggtgggacgctgggcggcctggcgctgattatgggctttggcgcaatgctcggtaagttactggccgactgcggtggcgcgcaacgtatcgcgaccacgctgatcgacaagttcggcacaaggcacatccaatgggcactggtgctgactggatttattgtgggttttgccctgttctatgaagtgggctttgtcttgatgctgccgctggtcttcagcgttgccgcatcggcacgcgtaccgctactgtttgtcggcgttcctatggcggcggcattgtccgtgacccatggttttctcccgcctcatcccggccccacggcgattgccacactgtttaatgccgatatgggcaaaacactgctgtttggaaccttactgggcatcccaacggtgattctcgccgggccagtttatgcacgtttcctgaaaggaattgataaacctattccagaagggctttataaccccaaaacgtttagcgaagcggaaatgcccagctttggcgtcagcgtctggacatcccttgttcccgtcgtcctgatggcgctgcgtgcggtagccgaaatggtgctgcccaaaggccatgcgttgttgccttatgccgagttctttggcgatcccattatggcgacgctgattgccgtgctgattgcgattttcacttttggtctgaaccgtggacgcagcatggaacaggtgatggatacgctaagcgactccatcaaaattatcgcgatgatgctgctgattatcggtggcggcggtgccttcaagcaggttctggtagacagcggcgtggataaatacattgccaatatgatgcatgccaccaatctgtcgccgctgtttatggcctggtctattgctgccgtgctgcgcattgccctgggttctgcaaccgtggcggcgattaccgcaggggggattgtggctccgttaattgcaaccagcggggcgagcccggagttaatggtgatcgctgtgggttctggcagcgtgattttttcacacgtgaatgaccccggtttctggttgtttaaagagtatttcaacctgacgattggcgaaactattcggtcatggtcggcactggaaaccattatttcggtatgtggtttggtgggatgcttactgctttcctacgtggtgtaagggtgcctgcataaagcagtagggccgcgcaggaccggcggcccgtactgttaatctgaatcttcaaatcccgcttttaccatctgttctcgcaatgcgcgggcaatttcacggttaccgccggtcaccggataaatcacgttattaacgacatcgtcaagatagtgcaccgcaaactcctgtcgggtaagttgcgtgccgccttcatcattgatggcgaaaaaacctttgatttgatcaccgctgtattttgccttgaggctatagcggcccatactggtatttatgctactcataaggtctctccctgctttgcatttttagtgtcaaaaccgtcgagctgtcctgtccgcataaattttagccaggattaatccgcaaaacgaagcggcaaggcaggtaaaaacctgctatgcgatgcttctcacagaaaataaccattaaagctgaatgttgcttcgatagatgagatcgcaataagcaaaaagcacagcctcaaatcttgcctatactgttatgggaatgtttttttaggtaagggagaggaaatgaaaataattctgtggattatcgccattatttttatcgtgggactactgaccctgacaggggtatttaaactgattttctgattctatgggcacctcaacggtgcccaaatcctttctgaccacctttgtcgcatcaagccgcgctatttatcctcttccctgtaagcctgtaagcctgtaagcctgtaagcctgtaagcctgtaagcctgtaagttctaccttcatcgctatctctctggcgtctttgcccgtcacgctggtctaggcaggtttgtccctgatgcaataatttacatcccaaactattaattatttctttattaatcgagtgattaaacggcgtttattcgtgcgccgattgcgcccgttttttgttttttagcgggcgcagcgggtaatcggtggcgtttaataaaggcaggataatcacctcatttagcgagaatgtggcaattgctggttgtttggctctggttcatcttccctgttttaaaatccctcacgctttagctcgttgagcataacggcatgccgaacagccgccagaagggtttcgctctctctgctgcaggcgggtttttacgttgttgttttcagtatggaacgctggatttagccaatacaataaaggtaataccgaagtgaacaggtcttttatcgcacgcttatcagcgcccttactggcgctatttttttcattttctctccaggcggtcatgctgacccagcagataaaatcgggctgggacactttcactgataatgtccagcaaacctggcaacagcctgactccattgatgtttatgtgcccgccatcacctggcataaccgctggacgtatgatgatgagcatatccacagatataacgaacgtccctggggagcgggtggtggggtttcacgttacgatgagaaaggtaactggcacggcctttacctgatggcgtttaaagattcctttaacaagtgggaaccctttggcggctatggctgggaagcaacctggcgaccactggcggatcagaattttcactatggtttgggctttaccgctggcatcacggcgaggaataactggggatactatcctgtgccggctttattgccgttagcatccataggttatgggccagttaattttcaaatgacttatattccaggtacttacaacaacggtaacgtgtattttgcctggctgcgctggcagttttaagcctcagaacccctgaataagtcactaaagggaaaataatagcgatatttatcactttttcatcaattcaggctggacaaaaccctcagcaattgctgtactagatggcgacacagtttagtgtccatttttcatgtaaaggtaatatagatgtctaagattaaaggtaacgttaagtggtttaatgaatctaaaggattcggtttcattactcctgaagatggcagcaaagatgtattcgtacatttctctgcgatccagagcaatggcttcaaaactctggctgaaggtcagcgtgtagagtttgaaatcactgacggcgcaaaaggcccatctgctgctaacgttatcagtctgtaagttaacagtcagaattctaaaaacccgccttctggcgggtttttttatggctgcacgcaaccacaccgttggttttcagcccggctttatgcggaacacttacacaatggcttcgctcttatcccaccgcactttccctcgcatcatcacgttctcgcgttaacccgggccgcacctggttctactgctacatcggactcaggcccattctgcagcactacaacgactggcaaactgcggagcgagtcacagataatccccgtaacataatcataacaactcgcaggagcagcattttacggcgtctcgggttataactgactctccgcatcgcagataaagaggtgacaggatgaatattcgtccagctcaggcgaaggacagcttcgtgttgagcgcgttgttaagtgaacttggttatggcggtacagagcattttattgagcaacgtcttgctcaactgatgaccgatccgaatgagaagctgctggttgcagagcacggcaatcaggtgctgggatttatctctctccattttattcctcagctggcgctggcgggtgattttgctcgcatcagctacgtgtgcattgccgaaggtgagcgtagcaaaggcgtcggacagaaactcctgcagcacgcagaagcgctggcggctcagcacggctgtgatcgcatggaagtgcactgtcatgcctcgcgcctcaaagcaaaccagttttatggccgtgaaggttatgttgaatcgccacgctatcatgtgaaagcattacagcctctgtaagatgacaggctcaccattgggctcacagagcgacacggcgtcgctggagaagggataatgaaagtcgcgctagggcaatttgcagttaagcgtgaatggcaggaaaacgccacaacctgcctgagcatgatggatcaggccagccgtgctgatgccgacctgttagtcctgcctgaggcggtgctggccagtgacatcacaaaccccgatttaattctggaagccgcacagccgctggatggaccattcctgtcgcaattgctggtcgccagtaagggcaccagactgacgacggtcctgggaatgcatgtaccaggtaataaccataaagtcttcaacgtgctggtggtgattcgcgacgggaagctcgtggcagagtatcgcaagctgcatctctatgatgcctttgccatgcaggaatcaacgcgggttgaagcgggtgaacaggttccacctctggtggacgtggcgggcatgaaagtaggactgatgacctgttacgatgtgcgtttccctgagctggcacggcggcttgtgctggatggtgccgacgtgctggtcttaccttcagcctgggtcaaagggccgttaaaagagatgcactgggatttacttacccgcacgcgtgcgctggaaaatacctgttatgtggtcgccgttggagagtgcgggacgcgtaatattggcaacagcatggtggttgatccgctgggtgtgccaataagccgtgcggccgagtctcacgcactgatcttcgccgagcttgacccgcaaagaatcgctacggcacgcgcaatgttaccggtgctggataaccgccggtttagtcggcctgaactggatgcgtcgcgctaagcgttattcggcaggacggggcctgggacctgaaggagggccaccgcgatcttactctgttacagattacgcttgaggttagggctaaactgcgcctaaataggggttaccgttattcgccagattataaaggttaaatatggaaggtatcagtattgccaagctgctgattatcggtgcgcttatcgtactgcttttcggcaccaataagttacgttctctgggtggcgatctgggctctgcaatcaaaggctttaaaaaggccatgaaagacgaagattccagtgcagcacgcaccacagcggaagaaacacctgcagaacgcgtttctcacaaagactaatgccacgtcagttttagaaaagtgttaatttttatttctgaccgcagtaaaaaaaaccagattgcggacaatctggtttttttgttttttaatgacggcggggtgagcgaacgctatttgacttccaggccttttgcctgcatatcggcgtggtaagacgagcggacaaaaggaccacaggccgcatgagtaaagcccatcgccattgcctcttctttcatctcatcgaattccgctggactgacatagcgctgaacgggcagatggtgacggctgggctgcagatactgacccagcgttaacatcgtcacaccgtgacgacgcaggtcgcgcatcacctcaacgatttcagcgttggtttcacccagacctaccatcaaaccggatttcgtcggcacttctggatgggcttctttaaagcgctccagcagtttcagcgaccattcatagtttgcgcccgggcgcacctggcgatacacgcgcggcacgttttcaaggttgtggttaaacacatccggcggggttgcagtcagaatctcaagcgcacgatccatacgaccacggaagtcaggcaccagggtttcaattttaatgctggggcttttttcccggatagcggtgatacagtcggcaaaatgctgcgcgccgccatcacgcagatcgtcacgatccaccgaggtgataacgacatagcgcagggccatatcggcgatggtctgggcgagtttacccggctcgttcgcatcaggcgcgttaggacgaccgtgtgcaacatcgcagaacgggcagcgacgggtacagattgcgcccaggatcataaaggttgccgtaccgtggttaaaacattcggcaaggttagggcaggaggcttcttcacaaacggagtggagtccgtttttacgcattgccgcttttatgccctgaatacgactggagtccgcaggcagtttgattttcatccactccggcttgcgtaaaatctcttgccggtcgacagccacagttttcaccgggatcagcgccattttgtctgcgtcacgatatttgacgccgcgttccatctgaattggtttactcataaatcagcaggttccggtcggattgcgatttgaaagctgtctcactcaacccgagaaggcggctttcaactttatttgaaaaaagtgcaaaaattatatcatctcatcgaccaggaagcagccaaagacagagccgataagttacatatttgtaaatacgcattcacagttaattcagtccgtggtcttaaccgggtgccattcgacctgttgataacccaactgctgggcaaacgtctccgccagcaacggctggacatcggcgagcgtgacctcaggccgaaagtgttgcaactgcgtcatgttcattccggcatagccacaaggattgatacgtaaaaaaggtgacaagtccatcgccacgtttaacgccagtccgtgaaaagaacagcccttacgaatacgcagtcccagcgagcagattttctcgtcacccacatagacgccaggcgcatcgggacgggctcgggcagccacgccaaagcgcgccagcacggcaatcacggtttcctctaaggcggtaaccaactgacgcacaccggttttgcggcgtttaacatcaatcagtacgtacataacctgttgtccggggccgtggtaggtcacctggccgcctctgtcgctctgtaccaccggaatatcgccgggcatcagcaggtgctcggcttttcctgcctggccctgagtaaataccgggtaatgttcaaccagccagacttcatcccggctttcggcagtgcgctggtcggtatagtggtgcatggcgtctgaggtcgattgccagtcacataaaccaaactggcgaataagaagcgtgtcagctgacaaaacgagtatccgttaaaaggcgagaggctgagtataacgctggcggcgctgaagttaaacgccttcgcgatgaggcggttatcgcggcgcagagagattgagggtgggatcggtgctggcatatcgccagccaataaaaacgggtcagtgcgttatccgcagcctgacccgtttacccttttttgaggaggttacagcaccatccgcacgatttcgattttgcccagttcttcatacagggtttcaacctgttcgatatgggtggcgttgatcgtgacgttgaccgagtgatagttacctttactgctgggtttcacttctgggctgtaatcgccgggtgcatggcgttgcactacctcaagcaccaaatcaaccagctccggctgtgccagccccatcactttgtaggtaaacggggtagggaattcgagcagttcattcagtttggttttcataatcactccggtacataaaaaacaggctcccgccgaagcgggagcatcatattaacctgtaatgggggcaaggtggcggtttttcaaccgccctgcgccattaaccgaaccagtgatggaacatcagtttgatgtagtcaacgatacggctgaagaaaccgccttcagaaacttcgttcagcaccaccagaggacgctgatcgatcgttttgccatccagttggaaattgatactgcctaccacctgatttttcttcagcggtgcatgcagttcagtattggtcagcacatagctggctttcagatctttcatgcggccgcgcggaatcgtcaggtaagcatctttctcgacgcccaactgtacgcgatcgctgttaccaaaccataccggttcagaagcaaactcttttccggctttcagcggcgcgacggtttcaaagaagcggaagccccaggtcagcagctttttactttcggtttcgcggcctttataggtatgtccgcccatcaccgctgagatcagacgcatctggccttctgtcgccgaggcgaccaggttataacctgctgccgcggtatggccggttttgatgccatcgaccgtcaaactggtatcccacagcagaccgttacggttcatctgacggatattgttaaaggtaaactctttctctttataaaccgcgtactcttccggcacatcacggatcagcgcctggccgatcagcgccatgtcacgtgccgagctgtactgtccttccgcatccagaccatgaaccgtctggaaatgggtgttttgcagacccagcgctttgacgtagttgttcatcaggccaacaaaagcatcctggctgccggcgacatagtccgccatcgctacgcaggcatcgttaccagactgcaatacgatgccacgggtgagctgagaaaccggtacgcggtcgcctggtttcaggaacattaacgatgaacccttgaacaccggattgccggttgcccacgcatcctgacccacagtaacgatgtcgtcctgatggatttttccggctttcactgcctgaccgataacgtagctggtcatcatcttcgtcaggcttgctgggtcgcgacgggcgtccgcgtttttctctgccagcacttttcctgagttgtagtcgataagaacgtaggcttcggcatcaatgtccggtacgcccggaatcatggtcttgagattaacatcatcagcgatagcaacatggctgagagagaaagcgatcagtgatcccactgtcaggcgttttaacaaacgagaaggtttcagcgtgttcatgtgtgggacgacaacatccatgggtttagggtttaaaaaagtcactcatcataacaaatgcctgatttacaggcatccggcttaatgactgggttgttagcagacgttaccaatcagagcatccctgtcggttaacggcctgctgtggtaacgaaggccgcgctctggccttcactgctcaggcgttgctgtaaagcaacggcttcagcacgggttttataaccaccaagttgtacgcggtagacattgcctgcattttccactgcaccggggacaccgaagcgctggcgcagactggcgagcaactgccgggcacgtgcagcatcattgatggcactgacctgaaccacatagcctgaaagcgatgatccgccctgagtcgcgggtgccgggtgagaggtcgcggcactggccgcaatcggtgctgcggctgccggagccgctgcagcaggtgcgctggcggcaggctcgctaccttccagcacgccgctcgctaacggctgcggggcacccagaaaaccgccgctctgcactggtgcgcccatggcatcatgactttgcagagtggcattgctcaccggcgagacatcctgcgcatcgggttcagtcgtcggcgctgtctgctgctgactgccaccgctcatcactggctggctgctaccgttcatcatcggctggctaccaccaccgttaccgttcatcacgggtgggctgctcatgaccgggccgttcaaatcgggacgcgaaggcagggcatagctctgtttggcgaccacggtgccgatggtgccgggaccggagagcgtgccgtctggcgcgacgctgatgtaatcaacgcgcacgcgggaattattggagatgttcaggcggtcacccgcggcacgagacagatcgataatgcgccccggcgtataagggccgcgatcgttaacgcgcacgacaatctgacgtccgtttgccaggttagtgacgcgcacatagcttggcagaggaagcgtcgggtgggcggcggtcagggcatcgggatcaaaggtttcccccgtcgcagtgcgattaccctgcgcttcttcaccgtaccaggtagccagacccacttcgctatagttggccggatttttaatgatgcggtagtttttaccgttgacgctgtagtcctgattggtcgacggattgaccggctcgtaacgaggctcaacgccaggaatttcaaccaccgggccgttataggcaggctggggtggcgcactttgttgttgcggttcctgggtagaacatgcagctaaaaccaatgaagccaatacaacgccaagccagtccttacgcatctgcgacctcttaaacacttttagataacatttttcggtgtgtgtggatcgacatgacgatgccaaatcctgccataagtacaataagcgccgatccgccgtaactgaccagcggcagcggaacgccaaccaccggtaagataccactaaccatgccaatgttaacgaaaacatagacgaataaaatcaacattaaccccccggccatcacgcggccaaaggtcgtctgtgcgcgggcagccacaatcagtccgcgcataattaacagcagatacagcaccagcagcaccagtacgcctaccagtcccagctcttcagccagcacggcaaaaataaagtcggtatggcgttccggtaagaactcaagctgtgactgggttccatgcaaccagcccttaccgcgcaagccgccagagccgatggcaattttcgactgaatgatgtgataacccgcgccaagcggatcggtctcgggatcgagcagcatcatcacgcggtcgcgctgataatcatgcatcaggaagaaccacagaatgggaataaaggctgcaaccagcagtacggcgataccaatcagtttccagctcatcccggacaggaagagcacaaacaaacccgatgccgccaccagaatagaggtaccaaggtcaggctgcgccgcgactaacagggtaggaagaaagatcagcaccagcgcaattgcggtgttttttaacgtcggcgggcacacgtcgcggttgataaagcgggccaccatcaagggaaccgcgattttggcaatttcagagggctgaaagcggacaaaacccaaatccagccaacgctgggcgcctttactgatttgcccaaaggcatccacggcaacgagcaggatgacacagacaatatacaaatagggggcccagccttcgtacacccggggcggaacctgtgccagcaccagcatgataaccaatcccatggcgatctgacccagcttacgctccatcataccggggtcctggccgctggcactccagataacaatggcgctaaaggtcagcagcgcgaggataatcagcataaagagcggatcaatgtgcatgcgcatccagattgtccgcttctgcgggctgtcattcatcgacatgattattcaccttcatagcctggcggtgtaggagccgcatctggcaggacagtattattgtcacctaacattatgtgatccagtatctgacgcattaccgtacccacggccggtccggccccaccgttttccagaatcatcgtcacggcaacacgcggtttatcatatggcgcaaatgcggtcatcagcttatggtcacgcaggcgttctgcgattttatgcgcgttataggtttcgttctctttcaggccaaagacctgagccgtacctgatttggcggcaattttgtaaggcgcatcggcaaagcttttgtgggccgtaccgttagggcgattggcaacgccatacatgccgtctttggcaatttcccaatagcctgaatggatgtcaccaatcggttgggaagggggctgacggtaaggcaccagggtgcggccctcgcgggtagcgcgcagcatatgcggcactttgataaccccgtcattgatgagaatcatcatcgctttattcatctgcagcggtgttgccgtccagtagccctgaccgataccgacaggaatggtatcgccctgataccagggctttttaaagcggcgcatcttccagtcgcgcgtcggcatattgcccgcactttcctgcggtaaatcaatccccgtacgcgatccatagccgaatttggtcatccattcggacagacgatcgatgcccatgtcataggcaacctgataaaagaacgtatccgcagactcttcgagcgaccgggtgacgttcagacgaccgtggccccattttttccagtcacgatagcgcttctcggagccgggcagttgccaccagccgggatcgaacaggctggtatttcgattgatgacgccagcgctgagcgcggacacggcgacataaggtttaaccgttgaggcaggcggataggcggcctggatggcgcggttatacagcggacggttctcatcttccagcaatccgcgatagtctttgctggagatgccgtcaacgaacaggttcggatcgtagctgggcgttgacaccatcgccagaatttccccggtgcggggatcgctcactaccacggcggcacggctaccggctaacagcgtttcaatgtactgctgcagtttcagatcaatcgtcagatagatatcgcgcccggcctgcggggattgctcatgcaactgacggatcacccggccacggttgtttacctcaacctcttcataaccggttttaccgtgaagcaggtcttcgtaataggcttcgataccgagtttaccgatatcgtgcgtagccgcatagtttggccatttcccttctttatccagacgcgccacatcccgatcgttgattttcgagacgtagcccacaacgtgggtcagggtttgcccaaagggatagtagcggcgctgatagcctttgacttctacgccggggaagcggtactgattcacggcaaagcgcgcaacctgcacctcattaaggccggtttttaccgggatagaggtaaagcgacgtgagcgcttacgctctttttcaaacgcctcaatatcgtcatcggtgaggtcgagcaccgggcgcaaattttgcagcgtttgcttgagatcgtcgaccttttccggcaccagttcggcctgataaatcgtgcggttcagggccagtggcgtaccggtacggtcataaataatgccgcggctgggcgcaaccggcaccagctttatacggttttcatttgaccgggtactgtagtcgtcgaaacggagaatctgcagatgatagagattgaccaccagcacggaggagagcagtaagatgccgacaaaagcgataaaagccctgcggacaaagactttttgttcggcgctgtaatcgcgaaaggcgttgctttgtaatttcatccgctacttgtaatgtctggagtgagcttatcggttattcacgatgataaggatgatttgtcgtaatgctccatgcacgataaaggctctctgcaaccagcacgcgcaccagcggatgaggcaacgttaacgccgagagagaccaactctgttccgccgccgctttacaggctggcgctaatccttcagggccgccaatcagcaggctgacatcacgtccatcctgcttccagcgctccagctgttgcgccaactgcggggtttcccagggctgtccgggaatatccagcgtcactatgcggttgcctttacctgtcgctgccagcatcgcttcgccttccttttccagaatgcgtttgatgtcggcatttttccctcgtttacccgcaggcacttccgttaattcaaacggcatgtctttgggaaaacgacgcaggtattccataaaaccggtctgaacccagtcaggcattttggtaccgacggcaacaagctgcaatttcaccgcttaaccccagagcttttccagttcatacaactgacggctctcttcctgcatcacgtgcacaatcacttcaccgagatccacaacgacccaatcggcggccgttttgccttccacgcccagtggcatcagaccggcagcacgggattcctgctcgacgtgttctgcgatagaggtcacgtgacgggtggaggtaccggtacagatgatcatgaaatcagtgatgctcgatttaccctgtacgtcgagggtaacgatgtcctgacctttcaaatcatcaatcttatcaacaacgaactcttggagtgctttaccttgcaaaaggttcccctttaaaactggatgagagcgggctggctgaaacccggaagacagccgaaaaatttagcggcgcagtatatcacgcccatatcagtcgcgatataagccggcgcggtctatgtaggtaatcacggaggcaggcagtaaatcgtcacaggcgagatgttgatggcgacgctgcctgatctcggtggcagagatggcatacagcggggtttctgccagccagatcgccccagccgggcgttgcctgagctgttggctgtcctgaatgacgtggcgatccagccagcgctgcatgtctggcgacgccatttccgtcggatagcctggccgcttacacactaaaagatggcacaggctgagcaggtcctgccagcggtgccatttgttcagcgacagcagggagtcctgaccgataataaagcccagcggttgttcgccccgttcggcccgcagcgcttctaaggtgtccaccgtccatgaaggcgtatcacgttgtaattcccgcgtatcaatgtcaaaaagtggcaacgtttttatggcgcactcaagcatttcaacccgctgttgcgggctggcttcgggctgtggccgatgcggtggcacattattgggcagcagggtaacccgggacaggccaatctgttcggccagtttttctaccgggcggagatgaccaaaatgaaccggatcgaaggtgccgccaaacagggcatgtaagtcagacatgggcaaggctcgcagggaacgcgcgattcgcgatcagcattgacagcgtctgcaactgtggccagaccgattgaccataatcctgtttcagcgtgatctcgatttgcatcaacaagtgaatagcctgctgtaatcgcgctgcatccaggcgttgcagtgcctcggtaaacaggttgcggcgattctgccagatacgctgctgatccatgagtgtacgcagcggctgttgtgactgatggcgctgcagatgcaacagggtcagcaaatcgcgctgcagggtgcgcagtaatatcgcgacttcgctctcttctctttcaagctgctgcagaatatgcagtgcgcgtcggcttttgccgccaagcagcgcatcaacccagtgataaggggtaaagtgagcggcatcgctgacggcggcttcaacgcgtggcagcgttagtttgccatcgggccactgcagtgacagtcgttcaagcgcctgggacaacgccagcaggttaccttcatagcagtagcagagtagctggacggcagcatcatcgatgtcgagcttaagggcttttgcacggctggcgacccagcgagggagctgagcctgttctggcgtctggcaggggaccagcacggcatgggccgaaagcgttttaaaccaggcgctgttttcctgcgctttgctgagttttgccattcggcaaatcagtagaatatcggcgtggagcagcggggccagcttgatgagttgctccgcgatagccgcattcggtccattttcaggaaactgtaacgtcagcgtctggcgttgagcaaacaggctcattgactgacagctaacaaacaggctgtcccagtccgtttgcgcatcgagcgtaaaactcagatgctcttcaaaaccctgcgccacggcgctggcacgaatcgcatctgcactttcctgcaacagcaagggttcattaccggttaataaataacaggcgcgcagcccctcacggagctgcgcgctgagttgttccgggtaaatcctgatcattgcggcattggcgtggcggaagaagaaacctccgcagcaggttgaaccggtttggaaatcgtcgatttggacgacatttgctgagattccatctgcgcagcatgaacagttagcagcttacgcaccaactgttcgcctgcgcgctggcgcatctcctgaataatcatgtcctgctcagcgtctttcgccagtgccgcgttagggttatcaaagaacgagcggtaaacggttgcactgatagggtagatccctttattcgggatcagcacctgagcagagaccgtcatcgtcaattgatactcagctgtggtaccgctgataaatacggaggcggtactacggctttgtccttctccgccaagacgtagcgttggcacggtcatgctgtttttctgcgtagtttcaacaatattcacgttgttgagacgcaactgctgacgtacggtacgcgccagagggccgtaagggtcaccactgtctaaaaccagcgttctcagttcggttggcacctgagtggtgccgcgcggatgaaaaccacagccagcggtgatgaccaccgccagcatgacaaacaacctgataatcggatgtcgcacagttcctcctgaacttaacccacaaccaggttaagcagtttgcccggtacataaatgactttacgaatgctaacaccatcaaggtatttcgctactaatggttcctcagccgcacgcgcctgaacctgttcctgggttgcatcggcgggtacggtaattttaccacggactttaccgttaacctgaacgacgaccagcagagaatcttcaaccatcgcggcgtcatcggccaccggccattccgcattgtcgatagtgccttcaccacccagcgtttgccacagtacgtagcaggcatgtggtgtgaacggatacagtaaacgcgtcacggccagtaacgcttcctgcatcagggcacgatcctgttcgctgtcctgcggcgcccgcgccagcttattcatcagctccatcacggccgcaatcgcggtgttgaaggtctgacgacggccaatatcatcggaaactttggcaatggttttgtgcagatcgcgacgcaaggctttctgatcatcgttcaggctggcaacgtccagggcaacggtagcccctttctgcgaatggtcgtaggccagtttccagacgcgtttcaggaagcggttagcgccttcaacaccggattcctgccactccagcgtcatatcagccggggaagcaaacatcatgaacagacgtacggtatctgcgccatagcgctcaaccatcagttgtggatcaatgccgttgtttttcgacttcgacattttgctcatgcctgcgtagatcacgtcacggccctgcgtgtctactgctttcacgatgcggcctttctcatcacgatcgaccgtcacatcaacaggagaaacccagttacgttcaccgttaacacccacgtaatagaacgcatccgctaacaccatcccctgacacagcagacgtttggcgggctcattcgaattcaccaggccggcatcgcgcagcagtttgtggaagaaacggaaatacatcaggtgcatgatggcgtgttcgataccgcccacatactgatccaccggcagccagtagttcgccgccgccgggtccagcatgccgtctttataatcggcgcaggtgtagcgcgcgtaataccatgaagactccataaaggtgtcaaaggtatcggtttcacgcagtgcaggctgaccgtttacggtggttttcgcccactctggatcggctttaatcggactggtaatgccgtccatcaccacatcttcaggcaggataaccggaagctgatcttctggcgtgggcatcacggtgccgtcttccagcgtgaccataggaatcggcgcgccccagtaacgctgacgggaaacaccccagtcgcgtaagcggtaattgactttgcgcacgccaacgcctttcgcggccagcgcatcagcaatggcgttgaacccggcgctgtgatccagaccgctgcactcggctgagttaaacagcacgcctttatcggtcatcgcggcagcgctgacatctggctcgctgccgtccaggttaaggataaccggtttgatcggcagatcgtatttagtggcaaactcccagtcacgctggtcatgggccggcaccgccatgacggcacccgtgccgtactccatcagcacaaagttagcgacccagacaggaacaggctcacccgttaatggatgcacagcaaacagcccggtagccatccctttcttttccatggtggccatgtcagcttcagccactttggtgttgcggcattcggcaataaaatcagccagggcagggttgcttgcggaagcctgcagggccagcggatggcctgccgcgacggcaacgtaggttgcgccatagaaggtgtccggacgcgtggtatagaccgtgactttctcgttgctgtccgctacgtcaaaggtgatttccaccccttcagaacggccaatccagttacgctgcatggttttgacctgctcaggccactcttccagcgtatccagatcgttcagcagctcttcagcgtaatccgtaattttgataaaccactgcggaatctctttgcgctcaactttggtgtcacagcgccagcagcagccatcgataacctgttcgttagccagaacggtctggtcattggggcaccagttcaccgccgaggtttttttgtataccaggcctttctcatagagtttggtaaagaaccactgctcccagcggtaatattctggctggcaggtggcgagctcgcggctccagtcatagccaaaacccagcagtttaagctggtttttcatgtaggcgatattgtcataagtccagggcgccggtgcggtattattttttaccgccgcgccttccgcaggcagaccgaatgcatcccagccgataggctgcagcacgtttttgccgagcatgcgctgataacgcgcgatgacgtcgccgatggtgtagttacgaacgtggcccatatggaggcggccagaaggatagggcaacatggacagacaataatatttctctttgccttcctgctcagtcactttaaacgtttcgtcttcatcccactgctgctgaacgcgggattcaatctcttccgggcggtattgctcttgcatggctgcctgtggtccttaataaatgacactttgctgactttacgatccgcatagcatacccataaggccgcacatcaacaacacttcccactttatgcaggggcgatttatcgctaaagcgtcagcgttttcactcttttaccattccttacccagtgaaccgggcaaatgtgacaaagtagctaaacttagtacaggtactgagcgcaaaaaggagaataaaatgaataaagtggcacaggagtatcacgattcgttggcggtattaaccgaacgtcttcgccacggcgatcgcgatctggatacattggtggaagatcggcgtcgtcatttacgtgcgcactcagatctgacaccagatgaagtcgatcgggcactggcctcggtgcgtcgcgatttagccgagttcggtcgtaactatgcagaagcggaagaaccggtggcggattcggtctttatgcgcgtgatccgcgaaagtatctggaaagagctggcagacatcacggataaaagccagctggagtggcgcgaagtcttccaggatttacaacatcacggcgtttaccaaagcggtgaggtggtggggctgggcaatctggtgtgcgaaaaatgtcactttactcgcgcgatttatacggcggaaaccctgtcacgctgtccggaatgcaatcacgatcagttttatcgccagccatttgagccctgacagaaacaggcgggcaccgtgcccgcctggtttttagtgcagaatttttgccaggaaatccttcgcccgttcagactgcggattattaaagaagtcctcttttttggtgtcttcgataattttgccttcgtccataaaaatgacccggttcgccaccttacgagcaaagcccatttcgtgggtgacgaccatcatggtcatgccttcctgcgccagttccaccatgacgtccagcacttcattgatcatctcaggatcgagcgccgatgtcggttcatcaaacagcatggcaatggggtccatgcagagcgcccgggcaatcgccacgcgctgttgctgacctcccgagagttgtccgggaaacttgtcggcatgagcagacagacccacgcgggtcagaagcttcagacctttatcgcgggcagccgccttatcccgcttcagcacttttacctgtgccagtaccaggttgtcgataatgctcaggtgagggaacagctcgaagtgctgaaacaccatgccgactttgctgcgcagcgtagccaggttggtttttttattgttcacttcggtgccattcaccgtaatgctgccttgctggatcggctccagaccattgacggttttaatcagggttgatttgcctgaacccgacggcccgcataccaccaccacttcacctttttgtacctcggtagagcagtcggtcagcacctgaaattgaccataccacttggaaacgtttttcaggttaatcatttaaaccgtcctttttctttttagatagctgaccaacagtgatgcgctcaggctgatcacaaagtagaccagaccagcaaacaaaatcatttctacctgggtaccgtcacgttcgccaatagtggacgcggtgcggaagaagtcagccagactcaggacataaaccagcgaggtatcctggaacaacacgatgccctgagtcagtaacagcggaaccatggcgcgaaacgcctggggtaaaataatcagtctcatcgactgccactgcgtcattcccagcgccagcgcagcgctggactgcccccgtgcgatgctgataatcccggcacgaatgatttcagagtaataggcggcttcgaacagggagaatgccaccatggctgagatcagacggatatcggtcttgggcgaaatccccaacacctgctgtaaaaagctgggtacaaccagatagaaccacagcagcaccatcacaagcggcaccgagcggaacaggttgacatacagcctggcaaaccagctgatgggcttgaaggtggacaggcgcattaccgccagcagcgtgccccagaggatgccaaacacaacggcggttatggtgatcttgaaggtgatgaccaggccactaagcagatagggcaggctgggaggaatagaactccagtcaaatgcgtacatcatttgcctcccgcgttgccaggcagacgcactttgcgttcaaccaggcccatcagcaacataatcaccagattaattgccacgtaagccagggtaatcgcggtgaaggattcataggcgtgcgcggaatagtccagcagttttcctgcctgtgccgccatatcaaccagaccgatcgtcgaggcaatcgccgagtttttaaccaggttaagcatctctgacgtcatcggcggcacgataacccgataagcattgggcaacagcacgtagcgataggtttgtggcagcgtcagccccatggccagcccggcgttcttttggccgcgcggcagcgactgaatggcggcacgtacctgctcgcaaacgcgtgcagcggtgaacaagcccagacagatgactgaggagataaagaactgcaggttagggtccagttctgacttgaaccacataccgagattctgtcccaccagctctggcgcaaccagataccaaaagaagaactgaacgataagggggatattacgaaacagttctacatagcaggttcctatcgtggataacaggcgattagggacagtacgcagaatgccaaaaaatgaacctacacagaaagcaataatccaggcacagcaggagacggctatcgtcacctgaaaaccggaccacaaccagccgagataggtggtattaccgaacggggcctgttcgagaaatatgccccagttccaatcgatacccataacgagctccggtaaaaaagggtagcagagctaccctgaagattgatgagcgacttaattcgcctgattcgggggaacgacccgtgcaggctgtctgtccacgtcgcagtttcagcaatcgagagggcgacaatgccgcccttgttatcgttgttaattcagtgccttgtcattaggcgttttgaacagcgttttcatgtcatcagacagttcaaagttcatgttcaggtttttaggcgggataggctgcttaaaccagatatcaaaccatttttctgcctggcctgaggtctgggctttcgcaatggtgtcatccaccagggttttgaactgtggatcgtctttgcgcagcatacagccataggcttctttagactgcggcgtacccaggatttcccagtcgtcaggctttttcgctttggcacgttcgccagccagcagcgcatcgtccatcataaaggccacggcacggccggtttccagcgtgcggaacgagtcaccatggtctttcgcgctgataatgcgcatatccatttttttctcgtcgttcagtttgtgcagcagcacttctgaggtggtgcctgaggtcacgacgacagtcttacctttcagatcgtcgaaatctttaatcggaccgcctttcttgaccagcaaacgggtgccgataacaaaaatggtatcggagaatgccgcctgtttctggcgttcaaggttattggtggtggaaccgcattcgtaatcgtatgtgccgttctgcaacagcggaatacggttttgcgatgtaatagggatcattttaatttgcagatcgggcttattcagtttggctttaatcgcgtctgcaatggcattggaataagcctgagaataaccaaccactttttgctggttgtcgtaataagaaaagggaactgatgattcacgatgcccgatgacaatgacgccattgtcattgattttcttcagggtaccgctcagatcttccgcctgggccgctcccgctgctgcgcttaacagcagaagagataatgccactttgcgtaattgcatgttccaactccttcatgtggaaattgcacaggatctacccctgtactgattgtgatgttgtgtgtattttgcgctgcttttcttgttatcccttcgcgcttaagcgctgagaatattcactaacatagcggattgttaactcaatgaaacaaaaaagtttcttttttgcgatgtcattcgcaccaaaaaaaggcaaataaaggccaatgcacataaagggtgcgcatcaggactctttttggtgcgccgcgcccgctaacaggcctgaatgccagtgaatacagaaacattttgcaatcatcgtgccaaaataaaatgacaatccggtgaaacgttagttttattgcagaagcagaagcagaagcagaagcagaagcagaagcagaagcaggaagagcagggagagaagatgtggcgaagccgcgcttcgccacagggaattagcggtgacgcctgataaaggcgatcagcccggccaacagggtggctaaccataccggccagagaccggctctggaatagggggtttcaccgcgggtgggcgttaccttgtccactaaaacatcccgggtgaactgcggcagaactttctccacatcgccatcggcattcaccacggcagtcacaccgttattcgtgccgcgcagcagtggcctgcccagttcgagtgcgcgcatgcgcgccatctggaaatgctgccaggggccaatcgagtgaccaaaccaggcatcattcgagacggttaacagaaagttggtatccggacggaagttggcgcgcacctgttcccctaaaacgatctcatagcaaatggccgtcgtcagatgataatttgccacgttgagctgaggctgcagataagcgccgcgactaaaggcagacatcggcaaatcaaagaaaggggccagcggtcgcagcaggtcagccatgggaacgaattcaccaaagggcaccaggtggtgtttctgatagcggttggggctgaagtagttataaggcttcggtccgcccagaacgattaccgtgttgtagtcatggtagcgattctgctccagacgcgaatccacgataccagtgaccagcgaactgccgcgcgcgcgtaattcattatccagcgaacgcaggaaaggtttctggttactttccagatcggtaatggccgactccggccagataataatgggggctttgcccattagtggctggctcagatcgctgtaaatacgcagggtattcagcagctgttgcgggtcccacttcattgactggggaatgtcgccctgcaccagcgccacattgactgcccgtgctggcagtggttgataccactgcagatagcgtaatggccagcacagggccagtaatgccagcgcacccaccaggcttttaatattgcgctgctgcagggcgtacaccagtaacccggcaacgatcatcatcaggaaggtgatgctttccacacccgccagaggcgcaatacctttcaacgggccgttgatctggctatagccaaactgtaaccacggaaatccggttaatatccagccgcgtaaaaactccgttacctgccataatgcgggggccgccagtgccagccgccacaaggtggttcgtggccaaatgcggttaagcaccccggcaaacagggccgggtaaatcgccagatacgccgccagcagcacgaccaggaatacgttaaccggccccggcattccgccgaaggtggcaatactgacataaacccagttgatgccgctgccaaaaaggccaaatccccaactgaaaccgatggcgctggcttgtgggctggtacggtttaaggtcaggatttgcaacccgcagagcgagagcagagcggcaggccagaaatcataaggggaaaaggcaagcgtgccacaggcgccgctgagtaaagccagcagcagacgtacccgctgccgctggtaaagtgaggctaatgccataaaattattcgtcatccagttgaggtagcgccgaattttccggaatttttacatgaacctggatgatacgacggctgtcagccatggcaactttgaactggtaaccatcgatgtcgatgctttcgccacgcgccggtagatgaccaaagccctgcatgaccagcccgccaatggtgtccacttcatcatcgctgaactgggtgccaaacacctcgttgaaatcttcaatcggcgtgagtgcacgaacggtataggtctgacggttaagctgacggatatcacgatcttcttcatcgtcatattcgtcttcgatttcgccaacgatcagctccagaatatcttcaatcgtgaccagtccggacacaccaccaaactcatcaatcacaatcgccatatgatagcgctgcgagcgaaactctttcagcatgcgatcaacacgcttgctctcagggacaaccaccgccggtcgcaggactttttccacgctgaaagcttcagattcactgctcataaacggcagcagatctttcgccatcaggatgccttcaacatggtctttgtcttcgctgatcaccggaaagcgagagtgtgctgaatcgataattacactcaggcactcttccaggttctgatttcgttttagcgtaatcatctgggagcgtgggatcatgatgtcccgcacgcgctgttctgcaatatccagcacgccctcgagcatgtcccgggtatcctgatcaatcaggtctttttgattggagtcacggataagacccagtagctcatcacggtttttaggttcaccgtggaacagttggttgattagtagggaaaaaaatccctttttactactgggtgcatcgctgttttgagaatggtcgtcgctcatggcggtttttaaagatctctctggtaaggaaattacgctgccggcctgttcgccagcagcaggatggcctgaatcacagcttcaggtgttttctttctccgaaatgtacggatcaggataaccaagagcaagcattatctctgtctcaataccttccatctcttcggcttcgccgtcttcaatgtgatcataacccaacagatgcagcgtgccatggatcaccatgtgcgcccagtgggcttctgtggtttttccctgttcctgcgcttcctgctcaaccacctgacgacaaatgatcaggtcgcctagcagcggtaattcgatgccgggcggggcttcgaagggaaatgacagcacgttggtcggcttgtctttgccacggtaggtcaaattaagctcatgactttcggattcatccaccacacgaatggtcacttcactttccggctgaaagggcatgactgccgcttccagccagtgttgaaactgactttccgtcggtaaattatcggtctgctcgcaggccagttgcagatcgaggatcacgtcgctcatgaattctcctgggcgctgtgttgggccgcaagggcgtcgcgtttacgctcttcagcttgctgatcacgacgtttttgatcggcttcttcccaggcttcataggcggtaacaatacgtgccacaaccgggtgacgcacgacgtcttcgctgtggaagaagttgaagctgatctcttcaacctcggacagcacctctattgcatggcgtaaaccggacttggtgtggcgcggcaggtcgatctgcgtcacgtcaccggtaatgaccgctttagagttgaagccaatacgcgtcagaaacatcttcatctgttcgatggtggtgttctggctttcatccagaataataaacgcgtcattcagcgtacgaccacgcatgtaagccagcggagccacttcaatcacgttgcgctccatcagtttctcaaccttttcgaatcccagcatctcaaacagggcgtcgtagagggggcgcaagtacgggtccactttctggctcaggtcgcccggcagaaagccgagtttctcacccgcttctacggcagggcgcgtcagaaggatgcggcgaatctcctgccgttccagcgcatcgaccgcggctgccacggccagataggttttaccggtacccgcaggaccgacaccaaaggtaatgtcatggtcgaggatattcgcgatgtactgtgcctggttcggcgtacgcggtttaatcacgccacgtttggtcttaatgttgaccgctttgccgtagtccggcacgctttccgctgtttgttccagcacccggctctctttgatggccagatgaatctgttcaggttcgatatccgggatcgcgccgcgcacgggcgcggtatcgacatagagcgttttcaggatatcaacggcggcattcacacacagcacccgaccaaccagtttgaactggttgtcgcggcgattaatctcaatgccaagacgacgttccagctgttttacattgtcatcaaacggaccacacaggctcatcagacggcggttatcagccggttcaagggcgatttcacgggtttcaatattcaaacgaatcctttgggtcactcagggccagttgagagggtttgctgctgcatcaaacgccttaagcggatgcatcgtaacgaaattatttatgcggtagcgccggggcgcaagcgtatgaagtgatatttgggcggcacaggcagaaaccaagtgcaaaacagcagaatgtgcggcagccagtgctgcgccgccgcacataacgagggatcagggctggaagaccccgacgccgatgtcattttctttacgggtacgggcaataacagacgcagggctttccgcaacgcgtaaaccgagttcatcttccgtgcgaatcagcttcccacgtaaggagttggtatacacgtccacgatttcgacgtcggcaaatttgccaatcatctctaccgacccttcaaagttcaccacgcggttgttttcggtccggcctgtcagctccatcacgtttttacgtgagatgccttccaccagaatccgctgcacgctgcccatcatgcggcggctgatcgccatcgcctgctggttaatgcgttcctgcagaatatagagacgctgcttcttctcttcttcgctgacgtcgtcaggcaagtccgccgctggcgtgccagggcgcgctgagtagataaagctgtagctcatatcaaagttgatatcgccaatcagcttcatggtttgctcaaagtcctgctgggtttcacccgggaagccaatgataaagtcagagctgatttcaatatcaggacgcgccgcacgcagtttacgaatgatggctttgtattccagcgcggtatgggcgcgcttcatcagcgtcagaatacggtcagcgccgctctgtacgggcagatgaaggaagctcaccaactctggcgtatcgcgataaacttcaatgatgtcgtcagtgaattcaatcggatggctggtggtgaagcgaatacggtcaatgccatcaatggccgcgaccaggcgcaacagttcagcaaaggtgcatacgtcgccatcaaaggttgcgccacgataggcgttaacgttctgacctaacagattgacttcgcgtacgccctgcgcggcaagctgcgcgatctccagcagaatatcgtctgagggacggctgacttcttcaccgcgggtgtaaggcaccacgcagaaagtacagtatttgttgcagccttccatgatggagacaaacgcggtaggcccatcggcgcgcggttcaggcaaacggtcaaatttttcgatttccgggaagctgatatcgacaaccggacttttgctgccgcgcacggtgttgatcatttcgggcagacggtgcaaggtttgtggaccaaagacaatgtccacgcaaggcgcacgctggcgaatatgatccccttcctgcgacgcgacgcagccgccaacgccgatgatcaaatccgggttgcgctctttcagttttttccagcgccccaactggtggaaaaccttctcctgcgctttctcgcggatagagcaggtgttgagcagcagaatatccgcctcttcagcttcctctgtcagggtgtagccgtgcgtgctgttcagcaggtcagacatcttagatgaatcgtactcattcatctgacatccccaggttttgatatgcagtttttttgtcatcgagctagccattaaatcagtgcagtgaagtgctgggggcgtattgtaatgctttgctgcggatgtgaccagcctgagggcttttctgatcgtgcctgatttttccggtacactttgcagtaagacaaccgcgctgaaaagtgacggcatatgagagggatacaagttatgcaggataaccagtttgatgtggtgattgtgggcggtggcatggtcggtgccgcgctggcatgtgggctgatgcagcacaagttccgtgtggcggtcgtggagcgggcaacgccgccaccttttgatccacacagcctgcccgatgtgcgtatctccgctgtcggttcctcttctgtggcactcctgaagcaactgaatgtctggcaacgtgttgaagcgatgcgctgtgcgccttatcgcaaacttgaaacctgggagtggcaaacggcgcaggtcaatttcgatgcagagtcgctggggctgcctgaactgggctatatggttgaaaataacgtgttgcaacgcgccctgtgggaagaaatggaacagcgcggggttacgttactctgtccggcgaccatggacgatctccagccctgcaatggtggctggacgttgtctttaagcgatgggaacgcggtgacggcagcgttggtggtgggcgcagacggcgctaactcgcaggtgcgacagatggccggcatcggtattcatggctggcgctatgcgcagtcctgtttactgatcagtgtgacctgtgaacatcctgcgggtgacgccacctggcagcactttacccctcagggccctcgtgcttttctgccgctgtttggtcatcatgcttctctggtgtggtatgactctgctgcacgcattcgtcagttgcaggccatgccgatgccgcagttggaaaaagagatcgccagccacttcccggcacggctggggcgttttcaggcgcacgcagcaggaggctttccactggtccgtcgtcacgccttacgctatgtcttgccagggctggctttagtgggcgatgccgcgcataccattaatccgttagcagggcagggcgtgaacctgggttatcgggatatcgacgcactgatggatgtgctgattgacgcgcgtggtaaagcagaagcctggtcatcggaacgggtgctgctgcgttatcagcgccagcgtcgcaacgataacctgctgatgcagagcgggatggacctgttctattttaccttcagtaaccgcattgggccgttaaagctggtacgtaatctgggattgattgccgctgaacattcgggcgtgctgaagcgtcaggtattacgatacgcattaggattgtaagcgctcgccacgcgttgcactgaggtgatgcgtggctgtatcagcaaatgccagatgccagatgccagatgccagatgccagatgccagatgccaaaaacaacaaagcccgcaaaagcgggctttgttgcttaatttggctggggtgcagggattcgaaccccggaatgctggtatcagaaaccagtgccttaccgcttggcgacaccccaatggtgtcaaatcaaattgtcttaaaatggctggggtgcagggattcgaaccccggaatgctggtatcagaaaccagtgccttaccgcttggcgacaccccaaaaaaatggtggctacgacgggaatcgaacctgtgaccccagcattatgagtgctgtgctctaaccagctgagctacgtagccaaattgtactgcctttcgatgatggctgggatacctggattcgaaccagggaatgccggtatcaaaaaccggtgccttaccgcttggcgatatcccattcgtccactcgcagccacgagattcatcgaaattggctggggtacctggattcgaaccagggaatgccggtatcaaaaaccggtgccttaccgcttggcgataccccatccatgctgccgaatcatgaaatggtgcgggaggcgagacttgaactcgcacaccttgcggcgccagaacctaaatctggtgcgtctaccaatttcgccactcccgcagaaaaaagatggtggctacgacgggaatcgaacctgtgaccccagcattatgagtgctgtgctctaaccagctgagctacgtagccatctttttttcgcgcaaccttcatcggcgttgcggggcgcattatgcggagttgactacacagcgtcaacaagttttttgccgttttttgccttcaaacgcctgtttgtctggcttataaccaggctgatgctttattcggcaatttttcagtgaatacaacgccaataacaaaaaaaatgggccgtattcggcccattacgcactcagtatagcacttatttataagcggactggtgcacgcctacggcgcgtcctgacgggtcatccatgtttttgaatgcctcatcccactcaatggctttcgccgatgaacaggcaacagacgggccgcccgggacgcattcagccgcgctcggcaacgggaacagttcttcaaagatttcgcgataaaggtaggcttcttttgagcccggcgtgttgtgtgggaaacggaagtgcgccgtcgccaactgctgatcgctgacctgtttcgccgccacttctttcagcgtgtcgatccagctgtagccaacgccgtcggagaactgctctttctggcgccatgccacactttctggcaggtaggacgagaagcattcacgcaaaatgtgtttttccatcttaccgttactgccgcacatcttgtcctgtgggttgatgcgcatagccacatcaaggaatttcttatccaggaaaggcacgcgggcttcaacgccccaggccgacatggctttgttggcgcgtgcgcagtcaaacatgtgcagggccagcagtttgcgaacgttttcctcgtggaactctttcgcgttcggtgccttatggaagtacagataaccgccaaagacttcgtcagcaccttcgcctgacagcaccattttgatgcccatcgctttgattttacgcgacatcaggtacatcggcgtggaggcacgaatcgtcgtcacatcataggtttcgatgtggtaaatcacgtcacgaatggcatcaaggccttcctgcaccgtgaaatgaatttcatggtgaaccgtacctaaatgctcggccaccagctttgcagctttcaggtccggcgagccttccaggccgacggcaaaggagtgcagctgcggccaccaggcatcgctcttatcctgatcttccactcgcttagcggcaaaacgcttggtcaccgctgaaatgatggaggagtccagaccgcctgacagcagcacaccataaggcacatctgacatcaggtggctttttacggattcttccagcgcatgtttcagctcggctgcatcagtcacgttgttttcaatgttctggtattccatccagtcacgctgccagtaacgacggatttcaccatcggtgctggaaaggtagcttcctggcgggaattctttgattgaacgacacaccggcaccagcgctttcatttcagaggcgacaaacaggttaccgtgctcatcgttgcccatataaagcgggatgatgccaatatggtcacggccaatcagataggtgcgttttacgctgtcatacaggataaaggcaaacatgccttccagctcgtcaaggaaatcgacgcctttctcctgatacagcgccagaatcacttcacagtctgatccggtctgaaaagcataacgatcgcttaattttgcgcgcagagcctgatggttatagatctcgccattcactgccagtacgtgggtgtggtcagcgttatacagcggctgtgcgccgttgttcacgtcaacaattgagaggcgctcatgagcaagaatggcatgatcgtcagcgtaaacgcctgaccagtccggcccacggtgacgcatcaaacgtgagctttccaatgcttttttgcgtaactcaacgggatcgcttttcagatccagcacaccaaaaatagaacacatatctgactcctgaactcacctgcggcgatgtaattttacgtttgtccggcagcctgtcgctgcgtgatgtataagaaaatgcgttatttcccaccctcaatgcaagaggaatcgtcttttgctgatgaaaatgttggtggcgagcgactaatattgaatttcatctaatgaaataaggtttttattgatggatcggcaatgaaatggaatttcagcacgctttttgaacgctggtaatggctttaacgggccagaaaggggagacgcaccgcctgttttgccagtgcgtcataagagaaaggcattaaaacaggtcgatatccgcgacagacgggaagatccagtcggggcggaaaggcatagcatcgatatcggtaagggtagaaacccctgaaagcaccagaatcgtttccagaccggcctgaaaaccggccaggatatcggtgcgaagattatcgcccacaatgaccgtttcctctgaatgggcctgcatcttgttcagcgcggcacgcataatataggggctgggtttcccgacataaaacggcctgcgaccggagatcttctcaataccggcacagagtgcgccgcaggctggcacgaagccccgggcgtgggtatccgggttcgttgcgatgaaacgcgcaccgtttgccacgaagaaggccgccttatgcatcatatcccagttaaatgagcgggtttcaccgacaatcacgaagtccgggttgacatcagtgatggtaaaaccggctttatacagctcgtgtaccagcgcgccctcgccaatcacataggcttttttgccttcctgccgacgcagaaagtcagccgtagccatagcggaggtgtaaaacaccgaatccggtatttcaatgcctgccgaggaaaaccggttcgctaaatcgcgcgccgtctgtgaaggataattagtcagcaccaccaatggcatatctttcgccagaatgcgctgcaaaaactcctgcgcgccgggtaccgccgtattgtcgtgcatcagcacgccatcaatgtcacaaattacatttttaatcgtcataaatgggttccgatgcgcgcagccatgcgtcaggctgcgcttagtcttccaaaagatgttgcagcagaatgccgtttaacatcgcccgttttgccagggcaaatgccccgatggcggagcgatgatcaagttgagagcgcactacaggcagatttttacgaaaggctgccagtgcctgcgtattaatgcaactttcaatggccggcagcaacacgcgttcagcttcagtgatttcgccggccaacacaattttttgcggattaaacaggttaatggcaatggcaatggctttacccagatagcggccgacgtgctcaatgacctcacttgccagcgcatcgccctgattagccgcctgacagatttgtggcatctggcaggcgtcctgcgtcagtacactgggataacctttattcagcaactctctgacgcggtgttcgatggcgccgttagccgcgagggtttcgagacagccaaagttaccgcaatgacagcgctcgcccagcggatcgacctgaatatgaccgatttcaccgacgttgccattactgcccagaaaaatctgtccattggcaataatccccgcaccggttccccgatgcagccgcactaatatcgagtcggcgcagtcacgcgttgccccaaaatagtgctcagccaacgccaggctgcggatatcatgcccaacaaagctggtaacgttaaagcggtttttcaggtttgccaccaggggccactgatccacattaatgtgcggcatatagcgaataacgccattaaggggatcgaccaggcctggcaggatcactgaaatggcgatcagctcacgaattttggcttcgctctgctgaataaaatgcgcgatggcctcgaacagtgccagctccagcgtttcctgcgtggtttgcggcagggggtaatcctgctgagccagtgatttaccgctcagatcgaacagcgttaaggtcgcatcgttgcggccaaggcgcacaccaatggtatggaagtgacgtgtttcagtgacgatggaaatggcgcggcgaccgccggtggatgcctgttgctccacctctttgatcaggccgcgctcaataagctggcgagtgattttcgtcacgctggcgggagcgagttggctgagatccgcaatctgaatgcgtgaaatcggtccctgttgatcgattaaccgatagacggctgcgctgttcagttgcttgacaagatcgacatttccaatttgtgtctggccgccagtggtcattcagtgcttactcgctcaggacgttatctccattgactaacgtctttataattttaaagtcgcgtgtaaagacggtcaggttggcgatttttcctgcctgaagggagcctgactgcttttctacgcccattgcccgtgccggataaagtgaggccatacgcagcgcttcatccagtggaatgccggcatgctcaacgctgttttgcacggcttcgatcatggtcaatgctgaaccgcttagcgtgccatgctcatcaacgcataatccatcacgataatatattgttttaccagcaaaaataaatttatcgattgcggcacctgcgggggcagtggcatcggtcaccagaaccagcttgtcacccttgatgcgcttggcattacgaacgttagcgtaatggacatgtaaaccgtctgcaataatgccgcagtatacatcaggcgcatcaaacagcgcaccgataaggccgggttcacgtcctgcaaaggtcggcatagcattataaaggtgcgtggcaaagcgaataccggcagcaaaacccgccttggcttcttcaaaggtagcattggaatggcccgctgaaaccacaatgccggcttcgctgagttgacgaatcacggcgcttccgacaacttccggtgccagcgtaaccttactaatcacatcagcattgtcacacaggaaatccaccattcgcggatctggcttacggatgagcgcaggattgtgcgttccctttttaaccacattcagccagggaccttccagatgtaatcccagcagatggtggggatatttctgcaaaaaggcgcgcatggtttccacggcgcgcaccatcagttcatcactgctggtaatcagcgtcggcagaaaactggtgcaaccggacttaacgttggcccggtgcatggtttccagcgtttccacgctaatggcatcgatgtcgtcattaaactgcacacctccgcagccgttgagctgcagatcaataaagccgggcgcgataattgcgcctccgacatcctgctgttcaatgcctggcggcaacgctgccagcgggcaaacgcgctcgattttgccgtcagcgatgaccacggcatgattatcaaaaatgtcatcgccgctatagatacggccgttcactaatgcgtacatcttattctcccggcttgcctgccgttaatgcgtctaaccgcaggtgacgtaatgactgtattaaacgccctgcatgttttccgcttccatttcacggaagtatttcaccgttttgactttcaactccatggtggcgggttcatcacagaccaccacggatttagcatgaagctggagacagctgatcgtccacatgtggttgacattaccttccacggctgcctgcagcgcctgggctttaacatgacccgtgaccaggatcatcacttcttcggcatccagcagcgtgccaacgcctacggtaagcgcgtactttggcacctgatccacatcaccgttgaaaaagcgcgaatttgctacgcgcgtatcgtgagtcagggttttgattcgggtccgggaagacagagaggaggccggttcattgaacgcaatatgtccatcattgccaacgccacccataaacaggtgaattttacccagtgtccgaattttatcttcgtaacggcgacattctgcgtcaatatctggcgcattaccattcagcaggttgatattttctggttgtatatcaacgtggtcaaagaaattacggtacataaaactgtggtagctttccgggtgctctttaggcaagccaacgtactcatccatattgaaggtcacgacgtgtctaaagctaacctggcccgatttgtgcatgtcaatcaggtgtttataggcttcaagtggggttccgccggttggcaatcccaggataaaaggcttgtcagcgctcggattaaacgcattaatacgattcacaatatggcgcgctgcccatttgccgacctgcgtgggtgtggataaaggaatcagtctcatgttgcacctcgaatgtgagttaatgatctgacgcgcagtaaacatgtgggtgaagcctaaaatacaggctcaaaggcagaggaatcagcgcgtcttgatatttcgcatcataaaataagtcggtccttaaagccagtaagaacgtccttaaaaatcgatttttggtgataattgtcacagatagtagctattaatttgtgaagcgaattaaattattattacactctacagcattgagtgtaatgccgtcagaggcttgctgctgacataacaacattaagcggcagcaaagctataaagtcagtttaaagggggatgggtcaatgttaagttacttacaacgagtggggcgggcgctaatggtgccggtcgccactttgcctgctgcagcaatattaatggggatcggctactggatagatccggacagttggggggcgggtaatgcctttgccgcactgctgatcaagtccggtggtgcgattatcgaaaacatgtcggttctgttcgcgattggcgtggcgtatggcatgtcaaaagacaaagacggcgcggccgcgctcactggctttgtcggcttcctggtggtcaccacgctgtgttcacctgctgctgtggcgatgatccagaaaataccggtggctgaggtaccgcctgccttcggtaaaatcagtaaccagtttgtcggtattctggtcggggtactgtcggcagaagtgtataaccgctttagccatgttgaactgccgaaagcgttctcgttcttcagtggtcgtcgcctggtgcccatccttgtgtctttcctgatgatcctggtggcgttcatcctgatgtatatctggccattaatttttaatggtctggtcaattttggtgagcacattcagaagctgggatcggtgggcgcgggggtttacgccttctttaaccgcctgttaattccggtcggcttacaccatgcgctgaactccgttttctggtttgacgtggcagggattaacgatattcctaagttcctcggcggcgctcagtcgctggcgaatggtacggcaatacctgggatcaccggtcgttatcaggcaggtttcttcccaatcatgatgttcggtttgcctggtgccgcactggcgatttaccactgcgcgcgtcctgaaaatcgggtgaaagtcgggagtatcatgctggctgcggccttcgcctcgtttttcaccggtattaccgagccgctggaattctcctttatgttcgttgcacccgtgctgtatgtgattcatgccgtgctgacaggcatttccgtgtttattgcggccagcatgcactggattgcaggctttggcttcagcgcggggctggtggatttggtgctgtctacccggaacccacttgcaacccactggtacatgctgattccgcaaggtctggtgttcttcgtcatctattacgttgtgttccgtttcaccatcaaaaaattcaatctgatgacgcctggccgtgagctggcggttgccggggatgaaaccgatggttatgacgtgaatgtcgacaccaccgataatggcgaaagtgcgaccgaatcgctggcgcgtcgttatatcggtgcggtgggcggttcagaaaacttaaccgctattgatgcctgtattactcgtttgcgcctgaatgtgaaggatgccagccaggtcaatgaaggcgtggcaaaacgcctcggcgcgtcaggtgtaatccgtctgaacaaacagagtgtccagattatcgtgggtacgcaggcggaaagcattgctatggcgatgaaaaaagtgctggtgaaaggtccggtcgcggcagcagcagccagtagcgccagcgcgccagcagcgaccagcgacgtgaaaccgcaggccgtactgaacagcgaaaaacgcgttatcgcgactttagtggcacccgtgagcggtgaagtcgtgttgttggatgcggtaccggatgacgccttcgccagcaaagcggtcggcgacggtgtagcgatcaaaccgagcgataagcgcgtcgttgccccgattgcgggtacggtggtgaaaatcttcaacaccaatcacgccttctgtctggaaagcgaaaacggcgtagaaatcgtggtgcacatggggctggataccgttgcgctcggcggtcagggctttacccggttagtggaagagggcgctcaggtgacggcaggccagccggtactggagatggatcttgactaccttaatgcgaatgcccgctcgatgatcagtccggtggtggtcagtaatatcgaagacttctcgggtttgacgctgttgactcagggccaggtcgtagcaggcgaaacgccgctgtatgaaataaaaggctaattcgctgtatccacaacaaaaggcaggaagcgattcctgccttttttattttaaacgcccaacaaacggttgtttctctgcaacgctttgtggatcatacccggatattacgtggtataaaccacccattctacgcgttgaggattttgagatgagtgaggctgaagcccgcccaactaactttattcgtcagattattgacgaggatctggcaagcggtaagcacagcactgtgcacacccgtttcccgccagagccaaatggttatctgcacatcggtcatgctaaatcaatctgcctgaattttggaattgctcaagattatcaaggtgagtgcaatctgcgttttgacgataccaatccggttaaagaggatatggaatttgttgaatccatcaagcgcgacgtgcagtggttgggttttacatggagcggcgacgttcgttattcatctgactattttgatcagctttaccactatgcggtggaactgattggcaaaggcctggcctacgtagatgaactgaccccggaagaaatccgtgaataccgtggcaccttaaccgcaccgggcaaaaacagcccttaccgcgatcgcagcgtggaagaaaacctcgccctgtttgaaaagatgcgcaacggtgaatttgcagaaggcaaagcctgtctgcgcgcaaaaatcgacatggcttcaagttttatcgtcatgcgcgatccggtgctgtaccgcatcaagtttgccgaacatcatcaaaccggcaacaagtggtgcatctacccgatgtacgattttacccactgtatttccgatgcgctggaaggcattacgcattcactatgtacgctggaattccaggataaccgccgtctgtatgactgggtgctcgataacatcacgattccggttcatccgcgtcagtacgaattttcgcgtctgaatctggaatatgccgtgatgtcaaaacgcaaactcacgcaactggtcagtgaaaagcatgtcgaaggctgggacgatccgcgtatgttaacggtgtccggcctgcgtcgccgtggttataccgcggcttcgattcgtgagttttgtcgccgtattggcatcaccaagcaggacaacattgttgaaatggcctcgctggaatcctgtatccgcgacgatctcaatgaaaatgcacctcgtgcgatggcggtgttggagccggtaaagctggtgctggaaaacctgcctgcgggtcataacgaagtgctcagcatgcctaagcatccgaacaaacctgaaatgggtacacgtgaagtgccattcagccgtgagatttggatcgatcgggccgatttccgtgaagaggcgaacaagcaatataaacgcctggttctgggtaaagaggttcgcctgcgtaatgcctacgtgatccgtgctgagcgcgttgcaaaagatgaagagggcaatattacctgcatctattgcacctgtgatgtggatacgctgagtaaagatccggctgacggccgtaaagttaaaggcgttatccattgggtttctgctgaacatgcgctgcctgcagagtttcgtctctacgatcgcctgtttagcgtgcccaatcccggtgcggcagacgattttctgaccacaatcaatccggattcgctggaaatcaaacaaggttttgttgagcccggcctgcgtgacgcggcagccagtgcaccttaccagttcgagcgtgaaggctatttctgtgccgacagcctgtattccacgccggcgcagttagtgtttaaccgtaccgtcggtttacgcgatacctggacgaaaatcggcgaataaccgacgcgtcattttcatcactggataatcaaaagggcgacttatcgcccttttttgttatggatattttttttaacgccgacatttcttctgagcacatcaacagtcattaattttatttttgtggaaccgctctcagtttaatttttttaataaatttccagatgttaattcttttttttcaggtacgctaaccctctgaagtctcagtttgcgggtttaaaaggaaaaaatgacggttttcgcacaggaagctaaacacagcgttatcgtgttgcatcagctcattgaacatatttttaatcatcgttatgacagtggcgacagctttcacctgctgctctctcactttcatcctgactttcgcatggtcacgccgcagggaaagcagcttaatctgaatgaagttgaagatctgtttcgtcgattgcagggggcaagggaggggatgcgcattgcgaccagcgaacacgtgattctttcagagcatgccaacgaagtgacgattcagtaccgtgaattgcaaatgatgaacggagaaaacaaaagccgtatttcgctggcgattctggattgcaccacctctgttcctcgctggcgctatctgcaggaaacgctggtggcctgactgacaggcataaaaaagccgatgcaagcatcggcttttttacttcaaaacggaaagaggttatttgtcgtgcagtgtttcgtcttcacggcagtcgcccagtgcacagtgaccgtacaggtacaggctgtggttggtgagcttaataccgtgacgcgtcgcgatctcacgctgacgcgtctcaatagattcatcactaaactcaatcactttaccgcaatccaggcagatcaagtgatcgtgatggtgctgctgtgtcagctcaaacaccgatttaccgccttcaaagttatggcgggttacgatgcctgcatcatcgaactggttaaggacacggtaaaccgtggccagtccgatctcttcgcccatgtcgagcaggcgtttatacagatcttccgcgctgacgtgatggcatgcaggttcctgaagcacttccagaattttaagtctgggcaatgtgactttcaggccagccttctttaatgcggtattgttgtcagtcatgcggatattgtcctgttactttagtcactcttgtggcacgtagcctgtatgtcgatcgaccgccattctcatttgcgtctcattatagaactgatgcgctgaaatgaaaaccgatgctcctgcggtgcgccagcggcgatgttcgctgcacatggcatggagagcggatgctggcatttcgcgttttgtcatctcagttccagggaaataagcagatgatcgatgcgggtattctacagattaaatggggaaagttacaaaaatgtagctattatttttataggaaaagacattcgcccagtgtgaacctgcgtccacactgagctcagcgcgatcaggcttcaataatttctttcagctgcagctcatcaaaaatctgcttcacccatttctcaacgcgttcgtttgtcagctctggctgacgatcttcgtcaatggccaggccaaggaaatggttatcgtctgccagaccttttgaggcttcgaaatggtagccctcggtcggccagtgacccacgatgatggcaccgttaggttcgatgatgtcacgaatggtgcccatggcgtcacagaagtattctgcgtagtcttcctgatcgccacagccaaacagtgcaaccagcttaccgttgaagtcgatctcttccagagtagggaagaagtcatcccagtcgcactgtgcttcgccatagtaccaggtgggaatgcccagcagcaggatgtcaaaggcttctaagtcttctttagtgcttttcgcgatgtcgtgaacttctgcaacgtctttacccagttgtttctggatcatttttgcaatgttttcggtgttaccggtatcgctgccaaagaagatgcctacgattgccatgggtaaaataacctcttaaatcctgatgatagaatgaatgccgaagcctattcagcaaataatagcagaccgggcaaacaggcggaacgtgtaaagccgcgacatttgtttctgtgtgcggtttacgcgcgttagtccagtttgagctgtgccaacagcatttgttcaattaattcgctgcggctgagattacgctgttcagccagcatgttcagcgcttccaccgcgtcgctgttcattttgagttcgacacggcgaagcccgcgccctttgtcacgtttcagttgattgcgtttgttgatacgcagttgttcatcgcgcgtgagcggactggttttggggcgaccagggcgacgctcgttagcgaacagatcgagcgtggtgcggtcagtgtgttcttttgccatgacttaatacaactgaatgggcgcgaacgaggcgtttccgctgcgcagattaaattattgactcttcccgcgggtaagttgccccacggcaaaaatttagcgcgccatcatactccaggctaaccacggacgccaatcttaaacttttacagccagttaagccgttttaaagtgcaaaaaagcgtcgaatactgcgtaaaaccgcatccggtttttcagcgtgcacccagtgcccggcaccgccgataacatgcgcatgggcggagggaaactgccggagtatcgcatcacggtactggttatccagatagggcgaatcgccaccgcgaataaacagcgcaggatggggccaggccggcacgtcttgccagccggcgatcaacgcatagttgtcccacaatactggcacattaaaacgccattcgccgttgctgaaggatttcaggatgaactgaatcacgccgtcttcatggatatacgtacgcatgacctctgcggcttcactgcgcagggtgacgcccgccgccgtgaccgcacggatagcggcaaagatctcatcgtgccgacgtgtctggtaatcaaccggggcaatatcgatcatcaccatctgttctatgcgctccggtgccagtgcgctcatcgtcatggcaattttaccgcccatggagtgaccgatgactgaaacctgagcgatcccctgcgcatccagtgtgtccagcatatcctgcgccatgacagtgtagttcatctcgtcagcgcgcggcgataacccatgattacgcacatcaacctgaattaaggggcgatcgtctttaagcccacgggccagtatgccaaggttatcgagactgccaaacagaccgtgaataagcaggacaggcgtggaatcagcaggagattgttcagtttgcagacgggcattcaaaatcatagcaaagttcttaagtgtgagacctgagcttaggttatcatggtttcaccttttcaggcgcgctgcttccagcggcattaggacatattctgacttttgcccataaaccgtttgaatgctatcagcctgtctgaatttaactttataatcttcatgttagaacctgccccctttctgaaatgcctgcgagcacgtcgggattttcagaaaatcgctggttctgtcgtgagcaaaaaaaccgtacggaataagatgaaaacgatcgaagttgacgaagagctctaccgttatattgccagccacacgcaacatattggcgaaagtgcatccgatattctgcgccgtatgctgaagttcacggccggtcagtcagcgactgtgactgacgcgcagcccgttgccgcatcggcaccatcaaaagcggcacagtcggcgggtaatgaatcgcgtccccaggatcgtgtacgtgcggtgcgtgaattactgctttctgatgaatatgctgagcagaagcgggcggttaatcgctttatgctaatcttgtcaacgctctatcgtctggatacggcggcgtttgccgaggcgacaacgtcgctgcagggccgcacgcgcatctatttcgcgggcgatgaacacacgctgctacaaggcggtacccatactaagccgaagcacgtacccggcacgccgtactgggtcatcaccaataccaataccggtcgtaaacgcagcatggtcgaacacatcatgctgtcgatgcagttcccttcggaactgacagagaaagtttgcggcaccatttaaactgaagcgtcagggagaagcgccaatggccaatcacccccgtgccgggcagcctgcccagcagagcgatttgattaacgttgcacaattaacttcacaatattatgtcctgcagcccgatgtggcgaacccagaacatgcggtgaaatttggcacatcaggccatcgcggtagcgcaggacgccacagctttaacgaaaagcacattctggcgattgcccaggcgattgcggaagagcgtagcaagaacgggatcaccggtccgtgctacgtaggcaaagacacgcatgcgctttctgaacctgcgctgctgtccgtgctggaagtgctggccgcaaacggtgtggacgtgattgttcagcaggacaatggctacacgccaacgccggcgatttcaaacgccatccttgagcacaacaaatcgggtggtcagctcgcggatggtattgtgattacgccgtcgcacaatccccccgaagatggtgggattaaatacaatccgccgaacggtggacctgccgataccaacgtcaccaaagtggtcgaagaccgcgccaatcagctgttgaaagacggcttaaaagacgtcaaacgtctgccactggaccaggcctgggccagcggtcgcgtggtcgagaaagatttgatccagccttacgttgaagggctttcacagatcatcgattttccggcgattcaaaaagccggcctgaaaattggcgtcgatccgcttggtggttccggtattgcctactggcagcgtattgcggagcactacaaacttgacctgacgttggtgaatgacgcagttgaccagactttccgcttcatgcatctggacaaagatggcgtggtgcgcatggactgctcgtccgaatgtgccatggcgggcctgctggcgtacaaagacaagttcgaccttgcctttggtaacgatccggattacgaccgccacggtatcgtcacgcctgccgggctgatgaatccgaaccattatctggcggtggcgatcaactatctgttccagcatcgtccacagtggggcaaagacgttgccgtgggtaaaaccctggtatccagtgccatgattgaccgcgtggttaacgacataggccgcaagctggtggaagtgccggttggctttaagtggtttgtggatggcctgtttgacggcagttttggctttggtggcgaagagagcgcgggcgcatccttcctgcgctttgacggtacgccatggtcaactgacaaagacggcatcatcatgtgcctgctggctgcggaaattacggccgttaccggcaagaacccgcagcagcactatgatgaactggccgcacgctttggtgcaccaagctataaccgtctgcaggcatccgccagctcggcgcagaaagcggcgctgtctaagctgtcacctgaaatggtcagtgcggatacgttagcgggcgatccgattaccgcgcgcctgacggctgcgccaggtaatggcgcgtctatcggcggattgaaagtcatgacggaaaacggctggtttgctgcccgtccatcgggcaccgaagatgcgtacaaaatctattgtgaaagtttcctgggcgcagagcaccgtgcacagatcgaaaaagaagcggtagagattgtcagcgaagtgctgaaaaacgcctgataagtcagttaaatgaaaaaagcgccgctggcgcttttttttatggcataaagcggtagccgatgccggtttccgttaacagatgtactggctgagtaggattcgcctccagtttctgtcgcaggtgtcccatatagatgcgcaggtagtggctgtgctcgacggcgttcggcccccagacctggcttaacagctgacgctgggtcaacactttacccgcgttgttcagcagggtcgtcagcaagcgaaactctataggggtgagatgaacttcctctccgccgcgcagcactctgcgcgccgcaatatccacggtgacatcggcgaagctgacttttggatcggcatgttgcccggcatggcgacgcaaagcaacgcgcactcgtgccagcagttcaccaatgccaaagggtttggtcaggtaatcatcagcgcctgcgtccagcgcatcgatcttatcctgctcgtcgattcgggccgacagaacaatcacgggcagcgcgctccactggcgtagttcgccaataaaggttttgccgtcgccgtcaggcagcccgagatcgagaatgaccagatcgggttttcgcgtcgctgcctcgatcagcccgcgctgcagcgtctcggcatcgaaaaccttcaggccttcactttccagcgcgatgcgcacgaagcggcgaatttctttctcatcttcaatgattaaaaccgtggtcacaccaagcctgccattgcctgaaaagggaaaacacactgtaccaacttttcagtcgttcgtccgtgttgccataaacctgcctcaaagatcatcgctacaaccgttatttaaccaaaatgtaactaattttcaaattgccgaaggaagaacaaaaaaagctcaaatatagtggtcagatgagtagtaaaattacacaatcaggcgtaatattagacgcagatcacatttaaccccgatttcgcgccaggaggaatccatgtaccggacctattcacgccataaaatcattttgcgccgtacgctggttatcctgttgggcctgctggcactgccggtcatgctgtttcgccaggatcgcgcacgtttttacagctatctgcatcgtatgtggtgtaaaaccagtgcaaaaccggtctggctggcgcagtctgaggccgcagccggtattttttggtaagcaggctgcgctaaccgcatccatctgctcaccgagaggcctgttctcttgctcgactcgaagggaacgggcttttttttaggcgttatcgcactctgcttcatggtgaaggctgatttccgttattttttgagctacacttaaacctctacaagttttcggaggttgtacaagtatgagcgaaaaaattccggttggaatcagcgcttgcttgctgggtgagagcgtcagatttgatggcggccacaaacgcctggctttcgccactgagcaacttaccccattcgtgcgttttgaacctgtctgccctgaaatggcgatcggccttcctacgccgcgtccagcgcttcgcctcgttaaaaccggcgatgatgacgatcttcacctgtgttttagcaaagaaggcggggaagatatcaccgataaaatgcgcaactggtccgaaaaccgggttaaatctctccatcatctttgcggctacattctgtgtgcaaaatcacccagctgcgggatggaacgcgtacgcatttatgaaccggccacgaacaataatcgcaaagcggggaccggcatttttaccgaatttctgcaacgtgaaatgccctggttgccgcttgaagaagatggacgcctgaacgatccggcgctacgcgaaaattttattggtcgcatctgcgcgctccatgagttttatcagatgtggaaagcgggcctgacgcgccacagcctgattgcctttcacagccgctacaagctgctgctgctggcccattcgcaaaaaaaataccgtgagctgggaccctttgtcgcctcaatgaaccagtgggaatcactggaggcttttgcctctgagtaccgcaaccggctgatggatttgatgtctcagcccgcctctcgcaccaaccacaccaatgttttgatgcacgttcagggatattttcgtagtcagttaagctcgcctcagcgtaaagagctgacgtcgctgattgactgctaccgccagggaacgcaacccctgttagcgcccatcaccatcctcaaacactacatggcggaatacccacatccgtggctgacgcagcagcgttacttcgatccttatcccgaagccctgcgcctgcgatatggacaatgattcaggagcattatgaccacccatttagtctggctgcgaaacgatctgcgcattaacgataatctggcactgcacgcggcctgcaatcaaccggatgccaacgtgattgcgctgtttatcgcaacgccgggacagtggcaacaacatgagatggcgccccgacaggccgctttcattcaccagaatctgtgcatacttcagtcttccctggcggagcggggcattccgctgcattttcatcagtgtgatgattttgcggccagcatcgggttcctggtcgaattctgccaaaagcagcaggttgatcggctgttttataactatcagtacgaagttaacgaacgtgagcgggacgccagggctgaaaaacggctgcatgaaatggacgtggtttgtcagggctttgatgacagcgtactgctgtcgccggggagtattcaaaccggtgatggcgagatgtacaaagtgtttacgccgttcagccgcgcctttctccgtcggttacagcaggggctacctgagtgcgtacccgcccccaaagcccgcgcaggtgcgccgcttagcggacaagaaagtatcccacctttcgattatccccacgccgatattgacgcgtcgctgtttccgcccggtgaacaggcggcgattaagcgattgcgtgagttcgccaaaaaagcggttctcgattattcaacgcagcgcgatctgcctgcgctggacagtaccagtcgtctgtcgggctatctcgctgtcggcgtgctctcgccacggcaatgcctgcatcgcatcctccatgaacagccgaaggcactggataacagcccggctaccgtatggatcaatgaactgatatggcgtgaattctatcgccatctcatcgtggcgcacccgcgtttgtgtaaacatcagccctttgtccactggacgcgcaatgtggagtggcaacgcaacagtgcgcatttcgaggcctggaaagcgggtaaaaccggttatcccatcgtggatgcggccatgcgccagatgcatacgcttggctggatgcataaccgactgcgtatgattacggccagttttctggttaaagatctgcttatcgactggcgggaaggcgagcgttactttatgcagcaactgatagacggtgatttggccgccaacaatggcggctggcagtgggcggcctcaaccggaacggatgctgcaccctatttccgcattttcaacccgaccacccaaggcgagcgctttgataaagtgggtgagtttatccgccgctatctgcctgagctgagcgcggtccctgatagtgatattcatcagccgcatcagtgggcgcagaaaaataacaagacactcgattatccagcgccaatcgtggaacataaagacgcacgtaaaaagacactcgacgcctttgagcgcgcgaagaacgcggcctgaggcggcaaggagcagaaatgaatcatcatgagttagaaaacatcgtcaaccagcagctggacacccacagcttcagcgattacgcgccaaacggccttcaggtagaagggcgcgccgaggtaaaaacggtgattaccggcgtcaccgcctgccaggcgttactggatgaagccgtggcccgtcatgccgatgcggtgctggtgcatcacggttatttctggaaaaacgagcctgcggttattaaagggatgaagcgccaacggctgcgtaccctgttgactaacgatattaatctctatggctggcacttaccgctggatgcgcaccctcaactgggtaataacgcgcagctggctaaactgctggacatcaaggtgatgggcgagatcatgccgctggtgccctggggcgaatttacccagccagtgacaggtcagcaactggcccagcgcattaccgaggtgctggggcgtgagccgttgcactgcggcgataatgcgcctgctgaaatccgccgtgtggcctggtgcagtggtggcggtcaagggtttatcgacagtgcggctgcctttggtgtggatgcttttattacgggtgaagtgtctgagcaaaccattcacagcgcacgcgagcagggcctgcactttttcgccgccggtcatcatgcgaccgaacggtgcggcatccgggcgctgggtgagtggctggcgacagaacatggccttgatgtgacctttatagatatccctaatcctgcctgatcctgtgggttctgtataacgcaacagaacccaaatctgttgacacatctctgtcactttcgcataactaccttcttcaggccgcaacaccagggcctgcttttggacgccagcatgatgcctgagcgcaatcattcagtttaccgggaggtgcgtgttgcaaaaaacacgatgctatatgctgggcgaacgtgcggtggtgctggaactggcgccgccggtttcactggaaagccagcagcgaatatggcacctgagccaccgcgtgcagtcacatgatgcgatacgggacgtgattcccggtatgaacaatctcaccttgctgctgcacgatgcgcccgctgatgcgcagcaggcgatcgaacagctcaacgactggtggcaggaaagtgaggcacaggtcatcgagtcccgtgtaatgcagataccggttatctacggcggtgaggtggggccagacctgacgctggtggcggaaaacgccggcatgtcagtaacacaggtggtggagttacacagcagtcgcgattacgacgttttttttattggtttccagccaggatttccctatctggccgggcttgatcctcgtctgcacatgccacgccgtgcggaaccccgcgttgttgtccctgccggttcggtagggattggcgggagtcaaacgggggtttatccgttagcttcgcccggtggctggcagctcattggtcaaacccagctggcgctcttcacgccacagcagcagccacccacgttgctgcatccgggcgataaagtccgttttgttccgcaaaaggaaggcatatgttaacaattcttcgggcggggctggcaaccagtattcaggattttggccgcaatgactggcggcaatacggtatcggcgtgagtggcgttctggatcagcccgccatgatcacggcaaatttactggtcggtaatccgccgggcagcgccgtgctggaaattgtcctgggtcagttcaaagcagaattcagacgtaatggctggttcgccttaacgggggccggctgtcaggccgaactggatggcaagcccgtctggaccggttggcggctgccggtcaaaaaaggtcaggtgctggtgctaaagaaaccggtccacgggatgcgcagttatctggcaatacagggcgggttcgatgtgccggacgtgctgggttcatgcagcacggatttgaaagccggatttggcggttttcaggggcgcaccttgcaggatggcgatcgtcttcctttaggccagccggggcagcctttcacccataaaaaaggtgtaaagcagttgctgtggggcaaccgtattcgcgcgctgccggggccggaatatcacgaattcagtgaagaggcccagcaaaagctgtggcgagcggcatggacactcaatccacaaagtaaccgcatgggctaccgtttgcaggggcctgccttgcaacgtgaaacctcacgcgagctgttatcccatggcctggtgccgggcgtcattcaggtgccgggtagcgggcaacctatcgtattgctggccgatgcacaaacgaccggcggctatccgcgcattgcctgcattatagagagcgatctctaccatctggcgcagatccgtctgggggaaccgatccattttgtgccctgtacgccacaggaggcgcgggcagcaaaacggcaacagcagcacgcactggatcaaatagcatggggactggctaatgaaaattgacttaaacgccgatctgggcgagggcggcgacagcgatcgtgcgctgttgcaactggtgagctccgccaatatcgcctgtgggtttcacgcgggcgatgcacagacgatgctgcaatccgtgcgctgggccagcgcatttggtgtggcgataggcgcgcatcccagctttcctgaccgtgagaattttggccgcagcgccatgcaactgccgcccgaaaccgtttacgcccaaattatctaccaggtgggcgcgctgaaaagcctggcggagagcgaagggcaatcgctggtccatgtaaagccccatggaatgttgtacaaccaggctgccgccgatgccgtgcttgcggacgccattgcccgcgccgttaaggccgtcgatgccggactgattgtcgtggggctggcgaacagcgaatctattcgggcggcggcccactacggcctgaaaacccgcgaagaagtgtttgccgatcgcggttatctcagtagcggtgccctggtgccacggggtcaacctggcgcgctaattgaagaggaagcgcaggctatcgaccagaccctggcgatggtgcagcaggggcgggtaaaaagcctgagtggtgagtgggttgcggtcaatgctcaaaccgtctgtgtgcacggtgatggggaacatgcactgcagtttgcgcaacgattacgtgccagcttcgccaataacaatattgctgtaaccagtcaataaagcggcacagccgggctgataagctcaggctttttttcatatcttacgaggggaaaatatggatagcgtagtgaatctctggccactcctgggcattgctgccatcgtagtcggcttcgttttgcgctttaatccggtgctggtggtgatcgtcgcgggctttgtcaccggacttgccgccatgatgccgttgggcgatattctgcaaaaactgggtgaaggttttctgaatacccgcaatctgccgcttatcctgctgttgccgctggcggtgatcggcttactggaacgccatggtttgaaacagcgtgcccagacgtggattgctcagattaaaaccgcgacggcggggcgattgcttatcgtctatctgtttgtgcgcgaaataactgcggcgctggggctgaccagcctcggtgggcatccgcaaatggtgcggccattgctggctccgatggccgaaggtgccagcgaaagccggtacggcgcgctgtctcctgagatacgccaccgcctgcgagccatgtctgccgcaacggataacgtcggtttattctttggcgaggacatctttgtcgctttcggtgccatcatcttcatgcacaattttatgcaggaatccgccggtattcagaccgagccgctgcatatcgccttatggggtattccgacggctgtcgctgcctttttgattcactccgcgcgtctgttaaggctggatcgtcaactggcacgtgaactgagcgctattaacagtcagaccagcaaagccaaaggagctcgctaatgttccagcaacagtatttgatgtggctggccggcgttatcttgctggtggtggccttgttgtcctggcgcgacagcgcgaacccgcgccgttttactaccggactgttttggggactgtacagcctgatttttctggtgggtgactggaccacgcgctggatgtcacagctcatggggtcaacagagagcggtacgcgcaccctgcatattaccgtcggcgttgcggtcgtgctgatggggttgattgccggatgtgggggcgtaaagctcgggcgctatcatcagcgcagcgaagaggaaaagcaggccagcgcacaacgcctcaaaaataaactctttctgcccgccttagcgattcctgtcgtaacggttattggcgtcctggcctttaataatattcccggtttacagagcgggttatttggaccaggcaaccactctaccctggtcacgctgttttccatgacggtgggctgcctgctgggttggctgattgccatgaaactgacccatgaaaagccggtgcagtcgatgcaggaaacccgacgcctgctggattgtgtgggctgggcctttcttttaccgcaaatcctggccacgctggggctgttatttactgctgcaggtgtgggcggtgccatttcccatattaccgaacagtatctggcggtggacaaccgcttcattgcggtaaccgtttacgcggtcggtatggcgctgctgacaatgatcatggggaacgcctttgctgccttcccgattattacggcgggcatcggtattcccattctggtgctgcagcatggtggtaatccggcggtgatggcggcaatcggtatgttttcaggctactgcggtacgctaatgaccccgatggcggccaactttaatatcgtgcctgcggcgctgctggagttgccagatcgtaatgcggttatcaaagctcaggtcccgaccggtgtgctactgttaatcgttaacgtttttttactctatttcctgatgtttctgtgaggcagcatgagaacggtattaatgacggcgtttgaaccctttggtggcgaatccattaatccatcatggcaggcggtgagtgcgctggaaggccagcagattgccggtgcgcgtattatcacgcgccagttaccggtcgtgttcagcgaggtgctggacgtgttgtatcaggcgctggatgagattaagccggatgccattatttccgtcggacaggccggtggccgcagcgatatcaccgtcgagcgcattggcattaatgttgatgacgcgcgcatccccgataacgcgggtcatcaacccgtggatgagccgattgtgcaggatggaccggctgcctatttctcacgcctgccgatcaaagccatcgtggctgctgtgcgcaaagccggaattccggcctcagtgtcgcaaaccgccggcaccttcacctgtaaccgggtgatgtacggtttgctgccctggctgcaccaacacggcagtgcggcacgggcgggatttatccatattccttacctgcctgagcaggcagcgcatcatccaggccaacccagcatggccgccgcaaccgtgatcgaggcgctgaaaattgctgtacacaccacgctggaaaccacccaggatctcaaggaagcgggtggcgcaacccattaagaggacaagtgatgccagaaggaccggagatccgccgcgtggcggatcagcttgaagttgccattgtcggtcagcctttaaccgacgtctggtttgcttttcctgcgttaaaaacctacgagccagcattagtgggggaaaaggtggcgtcaattgagacgcgcggtaaagcgctgctgacacacttcagcaacggtctgacgctctattctcacaaccagctttacggcgtctggcgcattgtgccgcccgacgtgcagccagagacccggcgacagttgcgcgtgcgtctggcgacagtagaccaggcgatattgttgtacagcgcctcagatatggcgttgctgaatgcggaaacgctggccagccatccgtttctcaatcgcattgggccagatgtgttaagccacgcgttgacggtggagaacgtcacgcagcggctgctttcagcgcggtttcgtcgtcgccagttcagcggcttattactggatcaggcgtttctggctggattgggtaactatctgcgtgcggaaatcctctggctggcacagctgctgccacaccacaacgcgcagtcactgaccgggtcacagcttgctgccttcagtgatgcgttgctctctgtgccgcgtcatgcctatcgtatgcgcgggacaatgaaaaagtatcacagcgaagcggcctttcgctttgaggtgttccaccgtcagggtaagcggtgtcggcgctgcggtgagacgattgaaaagggagtgttatcctcccgaccgttttactggtgcccgggctgtcagatgtaaacgccaggcggctctgaccgacagcgcggcagcaaaacgatggctcaggttaattcacaggtttctgttgcaggacatcacgatgacgcctgaaattgtgactgaacgactgatattaaaaccgctgacgttgcgggacgctgacgcgatgcaagcgacgtttccccgatgggaaatcgtccgctacctgatcgattcggttccctggccttatccggacggggccgccagagactatatcgccaatgtggcattacccgccgtcgccgcgggaaagggctggtactggacgttacgccgccgggaagaagaacaggtgatgattggggcgatctccctgatggacacgccggacaaccatcgcggcttctggctggtaccggaatggcaggggcagggttacatgactgaggccagcaatgccgttactgatttctggttcaatgtgctgcaaaaaacggtactgagaacacccaaagccgcgccaaatcaacgttcggtcgctatctcggttaaaagcggtatgcgttgtatcagaacgggaaagcaacgctatgtttcaggcgaacatgactccgaactctgggaagtgacgcgggatgagtggcgcaaattcagagcggctcaggctggcgaaacagccgcgaaaaagtaacattgtgccgtgatcagacagcatctttagcgataaggttaaacctgtccgtcctcaacggaacctgcatccttcgggcacaaaaaaacggctatgcgttgtcagcatagccgttttgtcgtcgatggcccggtgcgatattcgcccaggcgacaggcttatttatccagctgtgacgtaaagtcgcgctcggtataaccggtatacagctgacgaggacgggcaattttcatgccttcgtcgtgcatctctttccagtgggcgatccagccaacggtacgtgccatggcaaaaatcacggtaaacatggaagacggaatgcccatggctttcaggataataccggagtagaagtccacgtttggatagagtttacgctcgatgaagtacgggtcgttcagcgcaatgtgttccagctccagtgccacttccagcaggtcatctttcatgcccagctcgttcagcacttcatgacaggtttcacgcatgacagttgcgcgtgggtcatagtttttgtaaacgcgatgaccaaagcccatcagtcggaaggagtcgtttttgtcttttgcacgacgtacgaattctggaatgtgctcaacggtgctgatctcttccagcatgcgcagacaggcttcgtttgcgccaccgtgcgccggtccccacagggaggcgatacctgcagcgatacaggcaaacgggttagcgccagacgaaccggcggtacgcacggtagaggtggatgcgttctgctcatgatcggcatgcagaatcagaatgcgatccatggcgcgttcaagcacagggttaaccttgtattcttcgcaaggtgtcgcaaacatcatgtgcaggaagttacccgcgtaagaaaggtcgttacgtggataaacgaacggctgaccgattgaatacttgtaacacatcgctgccatggtaggcatcttcgacagcaggcggaacgcggcgatttcgcgatggcgttcaatgttcacgtccagcgagtcgtggtaaaacgccgccagtgcgccggtcacgccgcacatcacggccattgggtgcgaatcgcggcggaagccgtggaacagacgcgtaatctgctcatgaatcatggtatggcgggtgacggtgactttaaagtcttcgaactgttcctgcgacggtgcttcaccattcagcaggatataacacacttcaaggtagtttgagtgggttgccaactggtcgattgggaagccacggtgaagcaggataccttcatcgccatcgataaaggtaatttttgattcgcaggacgctgtagacgtgaaaccaggatcgaaggtaaacaggccgttagaacccagttcgcggacatcaacgacatcctggcccagcgtgccttgtaacacactcagttcaataggcttttcgtcgggtagggttagcgtcacttttttatctgtcattttcgtctccatagcgccttgggcaggtaaggatctttcgacacctgaaacgcgtgcatgttgcatttaggcagtacttcacggtgtcactctgcattataagcagtgaagggtacagagtgagaggcgcgttccacaggaaatgtaaagccgtgacatgtgcatatcgcggttgttaaagatccggtcaggacataacttctttgtaaccaataacctgatggttttaaaaactgttactggcaatgttacataacttaagcttaggagaaagtgtatccccataacttttgtgcatcataggattttatcggattagtttgtaactgaattgttgaactattgtcaaatcagataattaaatttgtatgaattgtgaaaaacgtgagaatgatcactgttctacccaaaattctccaaagagtttgtaggggaattgtaatcagaatgtgatcgtcctatacttccggccaggtctccggaataccctgacaccaggagccacccagcgtttgtaccacgtcatttaacactggatgttgctattttggtgacggataaagtctgaacagcgttgcggttcaggtcttatgtccggaggaagcaaaataaaaaagagctgtgtgggcaaaaccgtgaaaaaacaaagacctgtcaacttggatctctcgacgatccggtttcccgttactgcaatatcgtccattcttcatcgcgtctccggcgtcatcactctggttgctctcggcatcctgttatggcttctcggtctttctctctcttctcctgaaggtttccagcacgcagcgtctatcatgaatggcttctttgcgaagtttatcatgtggggcattttaactgcgctggcctatcatgcagtgggcgggatacgtcatatgttaatggattttggttatctggccgaaacgctggaagcgggcaagctttctgcgcaggtgacgtttggtattactgtcgtgctttcaattttagcaggagtcctcgtatggtaagcaatgcatccgcgttgggtcgcaatggcattcaggactggctgttgctgcgcgcgtcggcaatcctcattacgctttacatcatctacatcctgggtttcgtggtgatgacagacacgctaacgtatgacatctggcgtggcttcttcgcttctgcatttacaaaagtgttcacgctcctgacgctgttttccattctgatccacggctggattggtatgtggcaggtgttaacggactacgttaaatcagtggcggcgcgtctgctgttacagttggttatcgtagtggcgctgttgtcatatgctatttatggatttgttgtggtgtggggtgtgtaaatgagtttaccaatcagagaatttgatgccgtggtaatcggcgcaggcggcgcaggtatgcgcgcggcactgcaaatctcccaatcgggccagacctgtgccctgttgtctaaagtcttcccgacccgttctcatacggtatccgcgcagggcggtatcaccgttgcgctgggtaatacccatgaagataactgggaatggcatatgtacgataccgtcaaaggttccgactatatcggtgaccaggacgccattgaatacatgtgtcacgtcggcccggaagcgattctggaactggagcatatgggtctgccattctcccgtcttgatgacggccgcgtgtatcagcgtccgtttggtggtcagtcgaaaaacttcggcggtgagcaggcggcgcgaactgccgcagcggccgaccgtactggccacgctctgctgcatacgctgtatcagcagaacctgaaaaataaaacgacgatcttttccgaatggtatgcactggatctggtgaagaatgacgacggtgcgattgtaggctgtacggcaatctgcatggaaaccggtgaaacggtctacttcaaagcgaaagccaccattctggcgaccggcggtgcaggacgtatttatcagtccaccacgaacgcccacatcaataccggcgacggtgtcggcatggcgctgcgcgctggcgtgcccgtgcaggacatggaaatgtggcagtttcacccgaccggtattgccggtgcaggtgtactggtaacagaaggttgtcgtggtgaaggcggttatctgctcaacaaacacggtgagcgtttcatggagcgctatgcccctaacgccaaagacctcgccggtcgtgacgttgtggcgcgttcgatgatggtggaaatccgtgaaggtcgcggttgtgaaggtccatggggcccgcatatcaagctgaaacttgatcacctgggcgcggaagtgctggaatcccgtctgccaggtatccttgagctgtcccgtacctttgctcacgttgacccaattaaagagccgattccggtcattccaacctgccactacatgatgggcggcgtgccgaccaaagtgacgggccaggcgctgcgcgttaacgagcagggcgaagatgaagtaatcccgggcctgttcgccgtgggcgaaatcgcctgcgtatcagtacacggtgccaaccgtctgggcggtaactcgctgctggacctggtggtatttggccgtgcggctggcgtgcatttgcttgagtgtctggaagagcagggcgaactgcgcgaagccaaccaggaaaacattgatgctgcgatggcgcgcttcaatcgctgggaaaacaacacgacgggtgaagatccggttgaaatccgtaaagcgttgcagcgctgtatgcagaacaacttctcggtcttccgcgaaggcgatgcgatgcgtgaagggcttgctgagctgaaagagatccgtgagcgtctgaagtcggcccgtctggatgaccgttcacctgacttcaatacccaacgtattgagtgccttgagctggacaacctgatggaaacggcttacgccactgctgtggcggccaactaccgcaccgagagccgtggcgcacacagccgtttcgattatccggaacgtgatgatgcaaactggctgtgccatagcctctatgttccgcaaacggaaagcatgacgcgccgtgaggtgaacatgcaaccgaaactgcgtgcggccttcccgcctaaagcgcgtacctactaattgcggagatcatcatgagacttgaattttcgatctatcgttacaatccggatgtcgatgacaaaccgcggatgcaggactataccctggaagcggaagacggccgtgacatgatgctgctggatgcgttgatccgcctgaaagagaaagatcctacgctggcgttccgtcgctcatgccgtgaaggcgtgtgcggttcagacggtctgaacatgaacggtaaaaacggcctggcctgcatcacgccggtttcggcactgggcaatggcaagcagaaaatcgttatccgtcctctgccgggcctgcctgtcgtgcgcgacctggtggtggacatggggcagttttatgcccagtatgagaaaattaagcctttcttattaaacgacggtgaaaacccgccagcgcgtgagcatctgcagtcgccgggcgagcgtgcacatctggatggattgtatgagtgcatcctctgcgcctgctgctccacctcttgcccgtcgttctggtggaacccggacaagttcatcggtcctgcgggcctgctggccgcttaccgtttcctgattgacagccgcgacaccgaaaccgatgcgcgtctggataatctgagtgatgccttcagcgttttccgctgtcacagcatcatgaactgtgtaagtgtttgtcctaaagggcttaacccgacacgcgctatcggccatatcaagtcgatgctgctgcaacgcggcgcctagttgtaccaccgggaacctcaggttcccggtgttttacggaagcctctgtaaacgcggttccgaccacgtttacaaaggttcccttacgggccgggcgcgcgctgcgcacagtgctcgtatcgctgaactcactacggctaaccgcgaaagcggcaacaaatgaaacctcaaaaaagcataacattgcttaagggatcacaatgcagaacagcgcgatgaagccctggctggactcctcctggctggccggcgcgaatcagtcttacatagagcaactctatgaggatttcctgaccgatcctgactctgtggatgcagtgtggcgctcgatgttccaacagttaccaggcacgggagtgaaacctgagcagttccactccgcgactcgcgaatatttccgtcgcctggcgaaagacgcatctcgttacacctcctcagtcaccgatccggcaaccaactccaaacaagtgaaagtgctgcaactgataaacgcgtttcgttttcgcggacatcaggaagccaatctcgatccgcttggcctgtggaaacaggaccgtgttgccgatctcgatcccgcctttcacgatctgaccgacgccgattttcaggaaagctttaacgtaggttcttttgccattggcaaagaaaccatgaagctggccgatctgttcgacgcgctgaagcagacttactgtggctctattggtgcagaatacatgcacatcaataacaccgaagagaaacgctggattcaacagcgtattgaatccggtgcaagccagacctcattcagtggcgaagagaaaaaaggtttcctgaaagagctgaccgcggcagaaggccttgaaaaatatctgggcgcgaaattcccgggtgcgaaacgcttctcgctggaaggcggtgatgcgctggtgcccatgctgcgcgaaatgattcgtcatgcgggcaaaaacggcacacgtgaagtggtactggggatggcgcaccgtggccgtcttaacgtactgattaacgtactgggtaaaaagccacaggatctgtttgacgaattctctggcaagcacaaagagcatctgggcactggtgatgtgaaatatcacatgggcttctcttcggatattgaaaccgaaggcggcctggtgcatctggcgctggcgtttaacccgtctcacctggaaattgtcagcccggtggtcatgggatcggtgcgtgctcgtctggatcgtctggctgagccggtcagtaataaagttctgcctatcaccattcacggtgatgctgcggttattggccagggcgtcgttcaggaaacgctgaacatgtctcaggcgcgcggctatgaagtcggcggtacggttcgcatcgtcattaacaaccaggttggttttaccacctccaacccgaaagacgcgcgttcaaccccgtactgtactgacatcggcaaaatggtgctggccccgattttccacgtcaatgctgacgacccggaagcagtggcttttgtaacacgtctggcgctggactatcgcaatacctttaaacgcgatgtgtttatcgatctggtgtgctatcgccgtcatggtcacaacgaagcggatgagccaagtgcaacgcagccgttgatgtaccagaaaatcaaaaagcatccgacgccgcgtaaaatctacgccgatcgtctggaaggtgaaggtgttgcctctcaggaagatgccaccgaaatggtgaatctgtaccgcgatgcgctcgatgcgggtgaatgcgtggtgcctgaatggcgtccaatgagtctgcattcgttcacgtggtcgccttacctgaaccacgagtgggatgagccttacccggcacaggttgacatgaaacgcctgaaggaactggcattacgcatcagccaggtccctgaacagattgaagtacaggcacgcgttgccaagatttacaacgatcgtaagctgatggccgaaggcgagaaagcgttcgactggggcggtgcagaaaatctggcctacgcaaccctggttgatgaagggattccggttcgcctctcgggtgaagactccggtcgcggtaccttcttccatcgccatgcagttgttcacaaccaggcgaacggctcaacctatacgccgctgcatcatattcataacagccagggcgagttcaaagtgtgggactcggtcctgtctgaagaagcggtgctggcgtttgaatatggctatgccactgcagagccacgcgtgctgaccatctgggaagcgcagtttggtgactttgctaacggtgctcaggttgttattgaccagttcatcagctctggcgaacagaagtggggccgtatgtgtggcctggtgatgttactgccgcatggctacgaaggtcagggcccggagcactcctctgcacgtctggaacgctatctgcaactctgcgccgagcagaacatgcaggtttgtgtcccatcaacaccggctcaggtgtatcacatgctgcgtcgtcaggcgctgcgtggtatgcgtcgtccgctggtggtgatgtcgccgaagtcgctgttacgtcacccgctggctatctcttctctggaagaactggcgaatggcagtttccagccagcgattggcgaagtcgacgatctggacccgcaaggcgttaagcgcgtcgtgatgtgttccggtaaggtttactacgatctgctggaacagcgtcgtaaagacgagaaaaacgatgttgccatcgtgcgcatcgaacagctttacccgttcccgcatcaggcggtacaggaagcattaaaagcttattctcacgtacaggattttgtctggtgccaggaagagccgctgaaccagggcgcctggtactgtagccagcatcatttccgtgatgtcgtgccgttcggtgccacgctgcgctatgcaggtcgcccggcatcggcttcaccggccgtgggttatatgtccgtacaccaacaacagcagcaagacctggttaatgacgctctgaacgtcaattaattaaaaggaaagataatgagtagcgtagatattctcgttcccgacctgcctgaatcggttgcagatgccacagtagcaacctggcacaagaaaccaggcgatgcagtaagtcgcgatgaagtcatcgtcgaaattgaaactgacaaagtcgtgctggaagtgccagcttctgccgatggcgtgctggaagcggtgctggaagacgaaggggcaacggttacctcccgtcagatcctgggtcgcctgaaagaaggcaacagtgctggcaaagaaagcagtgccaaagcggaaagcaatgaatcgacgccatctcagcgtcagacggcttctctggaagaagagagcagtgacgcactgagcccggctatccgccgcctgattgccgagcataatcttgatgcttcgcagatcaaaggcaccggcgtgggtggacgtttaacccgtgaagatgttgaaaagcatctggcgaacaaaccgcaggcagataaaactgcagcacctgcggcggcacctgctgctcagcagccagtggctaaccgcagcgaaaaacgtgtaccgatgacgcgtctgcgtaagcgtgttgcggagcgtctgctggaagccaagaacagcaccgccatgttgacgaccttcaacgaaatcaacatgaagcccattatggacctgcgtaagcagtacggcgatgcgttcgagaagcgtcacggtgtgcgtctgggctttatgtcgttctacatcaaggccgtcgtggaagcgctgaagcgttaccctgaagtcaacgcctctatcgatggcgaagatgtggtttaccacaactacttcgatgtgagcattgccgtctctacgccacgtggcctggtgacaccggtactgcgtgatgttgatgcgttaagcatggctgacatcgagaagaaaattaaagaactggctctaaaaggccgtgacggcaagctgacggttgaggatctgactggcggtaactttaccatcaccaacggtggtgtgtttggttcactgatgtctacgccaatcatcaacccgccacagagcgcgattctgggcatgcacgccatcaaagatcgtccaatggcggtcaatggtcaggttgtgatcctgccaatgatgtacctggctctctcctacgatcaccgtttaatcgatggccgtgaatctgtcggctatctggtcgcagtgaaagagatgctggaagatccggcgcgtctgctgctggatgtctgattcatcactgggcacgcgttgcgtgcccaacctcaatactcttttcagatctgaatggatagaacatcatgaacttacacgaataccaggctaaacagctgtttgcacggtatggcatgccagcaccgaccggctacgcctgtactacaccacgtgaagcagaagaagcagcatcgaaaatcggtgcaggcccgtgggtagttaaatgtcaggttcatgccggtggccgcggtaaagcgggcggtgtgaaggtggttaacagtaaagaagacatccgtgctttcgccgaaaactggctgggcaaacgtctggtaacctaccaaactgacgccaatggtcagccggtaaaccagattctggttgaagccgcgaccgatatcgatcaggagctgtacctgggcgccgtggttgaccgtgcgacgcgtcgtgtcatctttatggcctcgaccgaaggcggcgtggaaatcgagaaagtggctgaagaaacgccacacctgatccacaaaatggcgctggaccctttgaccggtccacagccttatcagggccgtgagttagcctttaaactgggcctgaccggtaagcaagtcagccagttcactaaaattttcatgggtctggccaccatgttcctggagcgtgacctggcgatggttgagatcaacccgctggtgatcaccaagcagggcgacctgatctgtctggatggcaaactgggtgccgatggcaatgccctgttccgtcagccagagctgcgtgaaatgcgcgatccaagccaggaagatcctcgtgaagcgcacgcgacacagtgggaactgaactatgttgcgctggaaggcaacatcggttgtatggttaacggcgcaggcctggcaatgggtaccatggacatcgttaagcaccacggtggccagccagcgaacttcctggatgtgggcggcggcgcgaccaaagagcgcgtaaccgaagcctttaaaatcatcctgtctgacgacgccgtgaaagcggtattcgttaacatcttcggcggcatcgtacgttgcgacctgatcgcagacggtatcatcggtgcagtagcagaagtgggtgttaacgtaccggtggtggtacgtctggaaggtaacaacgctgaactgggcgctaagaaactggcggacagtggtctgaacatcattgcagcaaccagtctgacagacgcggcacagcgtgttgttgctgctgcggagggtaaataatgtccattttgatcgacaaaaacaccaaagtcatttgccagggattcaccggcggacaagggactttccactctgagcaggcgctggcatacggcacgcaactggttggcggcgttacgccaggcaaaggcggcaccacgcatctgggcctgccagtctttaacaccgtacgtgaagcggtggaagcgaccggcgcaacggcaaccgtcatctatgttccggcaccgttctgcaaagacggtatcctggaagccatcgatgccggtatcaagctgatcatcaccatcaccgaaggcatcccgacgctggacatgctgaccgtgaagatgaagctggatgaagcgggcgtacgcatgatcggtccaaactgcccaggtgtgatcaccccaggcgaatgtaagatcggtatcatgccgggccacattcatcagccgggccgtgttggtatcgtatcgcgttcaggcaccctgacctatgaagccgttaagcagaccaccgatatcggttacggtcagtcaacctgcgttggtattggcggtgacccgatcccaggttctaacttcatcgacatcctgaaaatgttccaggacgatccacagacggaagcgatcgtcatgatcggtgaaatcggtggtagcgctgaagaagaagccgctgcttttattaaagagcacgtgactaaaccggttgtcggctacattgccggcgtaacggccccgaaaggcaaacgtatgggccacgctggcgccatcattgccggtggtaaaggtacagcagacgagaagtttgctgcgctcgaagcggcaggcgtgaaaaccgtacgcagtctggctgatatcggcgatgccgttaaagccgtcctgccagccaaataacaggcctgagtattatcacagagccaccttcgggtggcttttttacgtctttgcattgaataatccacggcaccgcgtgtttaattttagtaccgcccataaataacataaaataatcttaagtattcctgtgatgtttgctattattaatttggcttaggatttcatcctggccgcaaaaaaagttattcaataagatataaagttaaatatttatagaaaagcaaattgcccgatgacagttttttaacaaagtcttcgtgagaacatatttctcatctcttttcattattccaaatcaattttctgtcatttataacaaactttactgctagcaaaggatgcggttaagcgcttaaattgcgctgcatcaatccagccttttaaaaaaatattcatacgtttgtacaaatacgggaaagcatcaatttttcatttattactcgttaaacgtttgagccacgctgctgcattggtgtttcacaggtttctgttaaccgttacgccctcatcccaggccgcacacagatctgtcctgtcgatgacaaaactggaatcaataatcagtcgttcctgactcttattcagtctgtacggatacagagttaaggtgaggagcaaggagtcattatgctagatattgtcgagctgtcgcgtttacagtttgccttaacggcgatgtaccatttccttttcgtcccattaacgctcggtatggcgtttttgctggcaataatggaaacggtctatgtgctgagcggtaaacaaatttataaggatatgacgaaattctggggcaagttatttggtattaactttgcgctgggcgtggcaaccgggctgacgatggagtttcagttcggcaccaactggtcttactattctcattatgtcggcgatatttttggtgcgccgttggccattgaaggattaatggcattctttcttgagtctacctttgttggcctgttctttttcggttgggatcgtctgggtaaagttcagcacctggctgtcacctggctggtggcgctgggctccaacatgtctgcactgtggattctggtagcaaacggctggatgcagaaccccatcgcctctgagtttaattttgaaaccatgcgcatggagatgctgagcttctcggagctggtgttaaatccggttgcccaggtgaaatttgttcacactgtcgcgtcgggttacaccacaggtgcgatgttcattttgggcatcagcgcatggtatttactgaaagggcgagatctggcttttgctaaacgctcttttgccatcgccgccagttttggtatggcagccatactgtccgtcatcgtgctgggtgatgagtcaggttacgagatgggggatgttcagaaaaccaagctggctgccattgaagccgaatgggacacccagcccgcaccggccgcgtttaccctgttcggtttgcccgatcaggcatcgcagcagaatcattacgccattcagattccctatctgttggggctgattgctacccgctcaacggatacgcccgtaaccggtctgaaagaactgatggcccaacatgaagtgcgcattcgaaacggcatgaaagcctatgcactgctaaacgcgctgcgcagcggcaataccgacccggccgtgcgtgaggcgtttaatcacagtaaaaaagatctgggttatggcctgctgttgaagcgctatacgccaaacgtctctgatgccagcgaggcgcaaatcaaacaggcaacgcaggattccattccgcgcgtggcaccgctgtattttgctttccgtatcatggtgctctgtggggtgctgttgctcggcgttatcgcgctgtcgttctggagcgtcattcgtaatcgcatcggcaaaaatcgctggttacttaaagccgcgctgtatggcattccgctgccgtggattgcggttgaggcagggtggtttgtcgcagaatatggccgtcaaccctgggcgataggtgaggtgctgcctacggccgtggcgaattcgtcgctcaccgttggggatattctgttctcaatggggctgatttgcggcctctatacgctgttcctggtggccgagatgtatctgatgtttaaatttgcccgcctggggccaagcagcctgaaaacgggtcgttatcaccatgagcagatggcgaaaaatgttcagccggtacgtggataaggagaaccgccatgtttgattatgaagttctgcgctttgtctggtggctgctgatcggcattttgctggtaggctttgccgtcactgatggcttcgatatgggcgtcggcatgttaacgcgcctgttaggccgaacggataccgagcgtcgggtaatgattaacaccattgcgccgcactgggacggtaaccaggtctggttaattactgcaggtggtgcgctgtttgctgcctggccgatggtttatgccgccgcgttttcaggattttatgtggcgatgatcctggtgctggcttcgctgtttttccgtccggtaggctttgattaccgctctaagattgaagacaagcgctggcgcggggcctgggactggggcatttttatcggcagcttcgtgccgcctttggtgattggcgtggcttttggcaacctgttgcagggcgtgccgtttcacgccgatgagtatatgcgcctttactacaccggaaacttctttcagttgctgaacccgtttggcctgctggccggtgtggtcagcgtggcgatgatactggcgcagggagcaacctatctgcaaatgcggacaaccggcgaactctatctgcgttcacgtaccaccgcacagatcgccacgctggtgatgatggtgtgttttgcgctggctggtctgtgggtgaagtacggtattgcgggttatgtggtgaccagcacgcttgatcactatgccgcttctaatccgctgggcaaaaccgtggtgcgtgaagccggtgcctggatggtgaatttccagcagcatcctgtgttgtggctgttccctctgctgggcgttgtgctgcccctgctgacggtgctgtgctcacggatgaacaaaagcgcatgggcgtttgtgttctcttcactgacgcttgcctgcgtcatcatgacggccggtattgccatgtttccgttcattatgccttccagcacggtaccgggcaccagtctgactatgtgggatgcgacatccagtttgctgacgctgaaaaccatgacctttgccgcgataatttttgtgcccatcatcctgctctacaccagttggtgttactggaagatgtttggccgcatcaccaaagagcatgttgaaagcaacagcaactcactgtactgattaaggagtcaacacatgtggtattttgcctggattcttggcaccttgctggcgtgcgcctttggtatcatcacggcgctggccatagagcatattgaagatggcgcgacgtcggatcggcaaccctgatgggccggttgattcagacggcgtatcgtctgatggataagggcctgtttcgggccctttcactgattctggcactctggctggcgggatgcctgttatggaatcccgcgcgctttgccagtggctcaggcggcattctgctgtggcaggggatgttgcttatctgggcggtgtgcacgggcgttattcacggcaccgggtttcagccgcgacgattgcgctggcgcgctttttttacccctttacctgccctggtggtactcttgtggggggtgagccggttttatctctgactgcctggcagcataacgcgctgaaacgtgagtttacttcagcgtctggtcaagaagcctccattaaagccttccggttgtaaccaactgataattattttctcctggccctggcagcccattcccaaccccaattgtcttgcgtatagtagcaacgtttaaaacgaggccgggatgtagagtgagtacaacgctgtttcgctggccggttcgggtctactatgaagataccgatgccggtggtgtggtttatcacgccagctatatcgctttttatgaacgagcacgtaccgaaatgttgcgtcagcatcatttcaatcagcagacgctgttagaacagcagattgcttttgtggtacggcgcataacggtggactatctttcggcggcgcgtcttgacgatcttctggaaattcagagcgaagtgacatcaatgacccgggcgacgatgacattcacccagcgtatcgtgaatgcagaaggcaaagtgctcaatgaggcagaggtcctgattgcctgcatcaacccacacctaatgaagccgattgcgcttcccaagtctattgtcgcggagttcaagcagtgactgacatgaacgttcttgatttgttcctgaaggcgagccttctggtcaaacttatcatgttgattttgatcggcttttcgattgcttcatgggcaatcatcatccagcgcacgcgtattctgaatgcggcgggaagggaagctgacgcctttgaagacaaattctggtccggcgttgagctttctcgcctttaccaggaaagccaggcgcgtcgcgaagagctgtcaggctcagagcaaattttttacgccggtttcaaagaatttgcgcgtctgcatcgagtcaacaaccatgcacctgaagccgcagtggaaggggcgagcagggcaatgcgcatttccatgaatcgtgagctggaagcgctggaaaaccatattcctttccttggcaccgtcggttccatcagcccgtatatcggtctgtttggtacggtgtgggggatcatgcatgcctttattgccctcggagcagtaaaacaggcaacgttgcagatggttgcgccaggtatcgcagaagccttgatcgctactgccattggtttgttcgcggcgattccagcggtgatggcgtataaccgactgaaccagcgcgtgaataaactggaacagggctatgacaacttcatggaagagttcacggctatcctgcatcgtcaggccttttccagcgacagcgctaagtaaacagaggtaaatgatggcccgagtgcgtggtcgcggtcgccgcgagctaaagtcggaaatcaacattgttccgctgctggacgttctgctggtgttgttgctgatctttatggcgacagccccaatcataacccaaagcgtggaagtggatttgccggatgcgacggattctaaaacggtttccagcgatgataatcctcccgtgattgtagaagtgtcgggtgtcggccaatacagcatggtggtggatcacgttcgtttatcgcagctaccaccggaacaggtgattagtgaagcgcaacgtcgtctggaagcgaatccgaaaaccgtcttcctgatcggcggtgcgaaagaggtgccttatgatgaaatcattaaggcgctgaacctgttgcatcaggctggggttaaatctgtcggtttgatgacgcagccgatttaaagtcgaaccgtttttgggaaccgagtgtgtcgaaggcaaccgagcaaaacgaaaagttaaagcgcgcgataatcatttcggtgattctgcatatcgtgctgattgccctgctgatatggagctcgtttaatgagcatattgaagccagcggcggtggcggcggtagcgatatcgaggcggtgatggtcgatcccggtgcggtggttgatcaatataatcgtcagcagaatcagcaaagtgacagtcagcgcgccgaacagcagcgccagaaacagtcacagcagcaggccgaagagctacagcagaaacaggcggctgaacagcagcggctgaaagagctggaaaaagagcgcttacaggcacaggaagacgcgaaacagcaggcgaaagcccaggctgaacagcagaaggcggcggaagccgccgcgaaacaggccgagtcacagcagaaagccgcagaagcggctgcagcgaaagccaaagcggatgctaaagcggaagccgatgcgcaggccaaagcggccgctgacgcgaaaataaaggctcaggaagacgctaagcaggccgcagcagaggcgaagaagcaggccgagcaacaggcgaaagccgcggcggcagaagcgaagaagcaggctgaacagcaggccaaagccgaggcagccgaggccgctaaacaagccaaggccgaagcggcgaagcaggctaaagcggaagcggccaaagaagctaaggccgcagaagccaaagctgccgcggaagccaaagccgcggcagctcaggaagccaaagaaaaagcagcgaaagaaaaagcggaagccgcagcaaaagccaaagctgaggctgccgcgaaagcgaaagccgacgcgaaagccaaagcggaggccaaggccaaagccgcagcggatgcagccaatgacagcgacgttgatgatctgctgggcggcttagcgtccggtaagaatgcgccgaaaagcggggcgtccggtggagcagccggacagggcaaccagaaaaaagcgggtgcctctggggccgaggtaaatgcctatcttgggcagattaccagtgctattcagagccgtttttacgatgcggatctttatagcggtaaaagctgtgacttacgtattaaactagcgcctgacggtatgctgattgatgtgaaatcagaagggggcgatccggctctctgccaggccgcaatcgcagcggcgaagcaggcacgtattccgaaaccgccttcacaagcggtgtacgaagtgtttaaaaacgcaccgatgcgtttcagaccgcaataatgcagtaacctgcggcaggttgatctatggttagcttgccgtactctagttgtactcgtggttttcaggaacagtgccaattatcgcggactcaggttcagataagggagataaaatgaagcaagctcttcgcgtaacgttaggcttttttatcctgttgtgggcagcgatgctgcatgcagaggttcgcattgaaatcacccagggcgtaaacagcgcgcgtccaatcggtgtggttccgttcaagtgggttggctcaggcgcggcaccggaagatatcggtggcatcgtcgcggctgacctgcgtaacagcggtaaattcaatccgctcgaccgctctcgtctgccacagcagccgaccagcccccaggaagtgcagcctgctgcatggagcgcgctgggtattgatgctgtcgtggtaggacaggttcagcaaaacgccgacggcagctatcaggtttcttatcaactggtcgatactgcaggtgcaccgggcaccgtactggcgcaaaactcctataaaatcactaaacagtggctacgctatgcggcgcataccgtcagtgatgaagcgttccagaagctgacgggcattaaaggtgcgttccgtactcgtatcgcctatgtcgtgcagaccaacggtggtcagttcccttacgaactgcgcgttgccgactacgacggctataaccagtttgtcgtgcatcgctcaccgcagccgttgatgtctccagcctggtcgccagacggcagcaaagtggcctatgtgacctttgaaagcggtaagtcagcgctggttatccagacgctcgctaacggcgcggtacgtcaggttgcctcattcccacgtcacaacggtgcaccggcgttctcgcctgacggcactaagctggcgtttgcgttatcgaaaaccggcagcctcaacctgtacgtgatggatctgggctcgggtcagattcgccagatcaccgacggtcgctacaacagtactgaaccgacctggttcccggatagccagaccctggcttacacctctgatcaggctggcgcaccacaaatttataagattggtatcaatggtggttcaccacagcgtattacctgggaaggtgctcaaaaccaggatgctgatgtggccagcgatggtaaatcaatggtgatgattagcaccagtggcggtgctcaacacgtcgccaaacaggatctggtaacgggagccgttcaaacgttaacggacacgttcctggatgaaacgccgagcatggcacccaatggcaccatggtaatctacagctctactcagggtatgggttctgtgttgcagttggtttccactgacggtcgtttcaaagcgcgtcttccggcaactgatggacaggtcaaatttcctgcctggtcgccgtacctgtaatgtttgagctttctgacattacaaaaaaataaacaataatgggaattttcaaatgcaactgaacaaagtactgaagggtttaatgctggctctgccaatcatggcagttgcggcgtgtagctcacacaaaaataacaacaacgaccagtctggcgcaggtgctgatggcgcttacggtgcgaactcaggcatgaacggcaacggtaacatgtcttctgatgagcaggcgcgtctgcagatgcaacagctgcaacagaacaacatcgtttacttcggcctggacaaatttgatgtgcagtctgactacgctcagatgctggatcagcacgctaacttcctgcgtagcaacccatcatacaaagtgactatcgaaggtcatgcggatgagcgcggtacgccagagtacaacatcgccctgggcgaacgtcgtgctaacgctgttaagatgtacctgcaaggtaaaggcgtgtcagccgatcagatgtctatcgtttcttacggtaaagagaaaccggctgttctgggccacgacgaagcggcttacgctaaaaaccgtcgtgccgtactggtatactaagagaatcacatggttagtaacttcagacatcacctgttgagtctgtcgttactgattggcgtagcggccccctgggccgctaatgcccaagcgtcaatcagtagcgttggctccggctcggtcgaagaccgtgtcaccagtcttgaaagaatctcaaatgcccaggcacagctgatgcagcaactgcagcagcagatgagcgataaccagcgggatatcgactcattacgtggggaaatccagcaaaatacctatcagctgaaccaggttgttgagcgccagaagcagatctatcagcagatcgacagtctgagcagcaacaacagcaatgccagtcagccagccgccggtgccagcgataacgccggtgcaggtgctgcagcctctggcacggagtctggtgcagcggcagccggtggtagtgcgccggtccagagcggcgatgccaacagcgattacaatgctgctgtcgcgcttattctggagaaaaaacagtacgaccaggcgatcactgcgctacaggcgtgggtgaagcgctacccggattcgacgtatcagccgaatgccaattactggctgggacaactgttttataacaaaggcaagaaagacgacgcggcgtattattacgccacggtggtgaagcagtatccaaaatcccccaaggctgctgaagcgttgttaaaggttggcgtgatcatgcaggagaaaaacgacacggcgaaagccaaagccgtttatcaacaggtgatcaaactttaccctgataccgaatctgctaagcaggcgcaaaaacgtttgtctggtatgtaatttgtgcaggtttgaccggatatcgtgtgatttctggtcttgccgcatgaaaggtaggcaattgaaccccttaacagaaaataagggttgcgctacctcggtaaatcagtaatatatgccgccgttgccgggacacattgcagatgtgtctggcaagcctgaagatgggtcgttagctcagttggtagagcagttgacttttaatcaattggtcgcaggttcgaatcctgcacgacccaccatctcccgcaggacgttgttccccaagagaaccttcagtattgcttcacaaccattaagatgggtcgttagctcagttggtagagcagttgacttttaatcaattggtcgcaggttcgaatcctgcacgacccaccatcttaatctcaggcatcattggtgaatgtgtttgagcggttgtaagccccgagcgggtcgttagctcagttggtagagcagttgacttttaatcaattggtcgcaggttcgaatcctgcacgacccaccaatacagaaaagagcgcccactgggcgctcttttcgtttgtaggctgcgcagtcaaacgtgcaggatgagaacctgctgcagggtcgactgaatcgcgcagcgattcaggctgatgcgccagcatcacccgaagggcgaggcccggacgggccgaggcaatcctgcacgacccaccaatgttgaaaggcgccctaaaggcgcctttttgctatgcgtaaaacgtgcagggtcgactgaatcgcaaagcgattcaggctgatgcgtcagccttaaccagtgggcgacctcaccgttaatgccataaaaaaagcgcccaacgggcgcctgtagtcgtggtgttactgcgagtcgcttagcgctgtatcgcttgacccggctccagattgaactgttttaacagcgtttcaagccgcagtgcctgatcttccaacgccgtagcggacagggcagacgcggagaccagcgtggcattttgctgcgtggtactgtccagctccgatactgcacgggcaatctgctcaataccgcggctttgctcgtcagaagcagaagagatctcaccgacaatgtgattgacgcgggaaatggcattcaccacctgtcccattctttcacccgcacgcgccacacgattgttgccctcggtaatctgaccgactgactcactgatcaggcgttcaatgtctttcgctgcctgagcgcttcgctgcgaaagattgcgtacctcactggccaccaccgcaaatccgcgtccctgttcaccggcacgcgccgcttcaactgccgcattgagcgccaggatgttggtctgaaacgcgatgctgttaatgacggcggtgatttcggcaattttctttgaactggccgagatgtcgcccatggtttgcacgacttcgctgaccgcggcaccgccttgttcagcctgcagagaggcttcagccgctatctgactggcatggcgggcgttgtcggcgttgtgcttaacggtaacagtcagctgctccatactggccgcggtctgcactacggccgcggcctgttgctcagtccgtgaagaaaggttgtgattgtcgctgttgatactgctcgccgcctgggagacggtgaagacgctgtcgcgcacttcctgaataatcgtccgcagacggtgattcattgcccccattgcccccgccagtttgcccagctcatcacggccgccaggcgtgatagtggcacttaaatcaccgctggcgatgcgctctgccagcatcaggtttcttctcaccggatgtgtaatctggcggctaatcagccaggcgatcaggatgcccagcagcaccgcaatgctcaccgtcagtagtgtcaggttgatagcgccgttggtcaggctgctgttttgcgatttcatctgctgcagaatatttttgataatggcactgcttttatcgccgtctgctttaaccgcgctctccgccacgttgagggcacgaaagcccgctgcataacgctcactgagttgcttgacgtcgagagtcgcgctccacaatgcattcaactgcgtctgtgcttctggcggcaactgcggtaacaaggccgtgatgctggactgaatcgcgttggattgctgttgaagctgcacgtctagcgcggcagcattagcgggatcgtaacggagtaactgaagctggtcgcgtaactggctgatggcaagaagttgctggaacagcacgctggcatcagtcacctgggtcttaatcaacgcttcatacagtgttgactggctttgcatgttgcgttgatcaagctgttttcccgttgccgccagcgcctgcatggcttgcgtcatcgcggtgatactgctctgaaagtggctgagttggctggcgatatcctgaagctgggtttgctgttccggctgccacgggtactgctgagcatcctgggtgagcagagaggcatgagcaatgtaatcagccatgacttttcccgctttttcatccccatacagcagtttcagccggtttatttttgcctggaatacatcgatgttgatgtcgtaaatcacgttgctctgttcataaacgtcatggatgtttttaaagcgtaatacgctaatactgcccgatcccacgactaacaataaaacgagtccaaatcccaaactgagtttatgcgctatttttgtattttctaaccgcaacgccatgactgctgcctcctgcccatgtcaacgatgttaagccaaattggttatcggttgcacggcacaggagtttagtgaggatgcggttatttttctgattatgcgtaatcgcaaaatcgctgcgcgatcatcacaggcttttccagatatgcatcacagcatagctgcgccaggggcgccattgctgtgaacgcgcttctgcggccttgggcgtcaggccacccaggttattccgtatggcgatatcttcttttggaaaagcatccggccagcgcagagcgcgcatggcgatataatgggccgtccagggaccaatgcccggaagtgccaccagacgcgccatgatgtcatcaggcgtgagcgtggcgttaaaccgtaagctgcccgccacacaggcgtcagcgaaggccagaatcgctctggcgcgtgcgctgacaatgccaaggctggcaatctcatcgaccgtcgcctgcgcaatgcgctgcggttgggcagagtagcgagacaggtccgcgaaaggcgtcgagcaaggctcaccaaacgcctgggcaaaccggctgctgagggttgtcgctgctttaacggtgacctgctggcccagaatggcgcggacgcccatttcaacgctgtcgaacgcaccgggcacgcgcaggccgggaaagtcatgaaggctttgtgccagcagcgggtcctgctgcaggtgggcagcaatgcgttgtggctgggcgttcaggtcaaaaagatcgcgcaggcggcgcaatagtgctggaagtacaggcgtcagagacggggtgaactcgaccttgagcgcctgcttagccggaaggttcgacacgctgacccagccacgatattgacccagcacgaccgtccggcgataggtttgcccctcaacgctctcgatctctttcatcaaccgtaactgcaaaaaatccagcatcgcctgccagtcgtaaggcggacgatagctgagctgtaactgcatggtattgccaggctgctgaacggactgcgcagccgttttacgtaaagcacccggcgtcatacgatagcgggcctggaacacgtcattaaagcgccgcaaactgccaaaaccgctggcataggcaatatcggtcaccgacagggtggtttcggtcagcagctgtttagccagtaacatgcgacgtgtctgtttaagctccagcggggtaacgcccagctcctggtgcacaatccggcgcagttgacgtgcgctgatgccaaactcggtggcgatatcgtccagccctgtatgctcttccagcaaaccttcttcgatgcgctgcaccaggcgatcggccactctgtgcgcattgtctacgggcgcattgcccggtgccagctcaggacgacagcgcaggcaggggcgaaaacgggctttctccgcggcttccgcgctgctgaagaacagacagttttttttcatcggcggcttaaccggacatatcgggcgacagtaaatgccggttgaggttacgccaacaaaaaatacgccgtcaaaacgcgtatcccgcgacgttagcgcctggtaagccgtatctggatcaaacatggtttctctccggcaaatagcgacagcgtagcgctggcagaaagggttgactggctgttttcggacagcacatcagtttattgtaatgaccgaaaacagccagtttagcgctaaaaaaatgcgataatgccagacagaattgtgatgggaggaaccgcatgtattactgcaaacctgtaacaaccccggtgggagagctgacgctgattgccagcgatcgtggcctggcggctattttgtggcaagacgaagtacgcaggcatcctcgcttatcgcccgtagagcgggacgataaccatccggtgcttcaggaaacggaaacccagttgcgcgaatattttgcggggacgcgccagcgctttacgttgccactggatttcgccggcacggcattccagataaaagtgtggcaggcattactgaacattccttttggtgaaacgcgcagctatcggcaaattgccgagcagattggtcatcctgccgcggtgcgcgcggtgggggcagctaacggtcaaaacccgttgtcgattgtcgcgccctgtcatcgtgtcattgggaccaacggcaaactgaccggctttgcaggcgggctggcggtcaaagcgtttttactccagctggaagcaccacagccgggcctggtggggctctcttcaacatgaccgcgaaataaaacacgacactccgccgcttttccgctatcgtgtttagcatataaaacacgatggcagtatttacgtcctgttaagccataaccggcgattttcgttaattttacagaacgagagcggtgtcatgagtacaatcttcgatcctgaaaacgcggtttatccttttccgcccaagcctgcccggctgaacgacgagcaaaaaaccttttatcgggaaaaaatcaaagcgttgctgaaagcccgcaatgccgtgatggtagcgcattactacaccgatccggagattcaggccctggcagaagaaaccggcggctgtgtctctgactcgctcgaaatggcgcgttttggcagccatcacaccgccagtacgctgctggtggccggggtgcggtttatgggggaaacggccaaaatcctcagcccggaaaaaacggtactgatgcccacgctggaagccgagtgctcgcttgatctgggctgcccgattgacgaatttaacgctttttgtgatgcccatcccgatcgtacggtggtggtgtatgccaatacctcggcggcggtaaaagcgcgcgccgactgggtggtcacctccagcattgccgtggaattgatagaacatctggatagcctgggggaaaaaattatttgggcacccgatcggcatctggggcgctacgtcacccagaaaagcggcgccgatgttttatgctggcagggtgcctgtattgtccatgacgagttcaaaacccaggcactccagcggatgaaagcgctgtatcccgatgcggcggtattggttcatcccgagtcaccccaggccatcgtggatctggccgatgcggttggctcaaccagccagctgattcaggccgccaaaaccttgccccatccccagatgatcgtcgccaccgatcgcggcattttttataagatgcagcaggcggtgcccgacaaaatattgctggaagcgccaacagccggtgagggcgccacctgccgcagctgtgcgcactgcccctggatggcgatgaacggcctgaaagccatcgccgatgcgctggagtcgggtggtcaggctcatgagattcaggtggaggcggccctgcgggaagccgcgctggtgccgcttaaccgtatgctatcctttgcagcagaccttaaacataacgtgaaaggaaacgcgtaacgcgcgtcgttaacaggtgcctcatatggatttttttagcacgcagaatattttggttcacatccctcttggcgccacggggtacgatctgtcatggatcgaagccgtcggaacgctcgctggcctgctgtgcatctggctggccagcctggaaaagatcgttaactacgcctttggtctgatcaacgtcacgctgtttgcggtgatcttttttcagatccaactctacgccagcctgctgctacagctatttttcttcgcggccaatgtctatggctggtacgcctggagtcgacaaacatctgacaatcaggcggcgttaaccatacgctggctgccgcggacaaaagccatcggctgggctgttggctgcgtcatcgcggtggccttaatgacggtgtatatcgacccggtatttgcatttcttacccgaattacggtcgccattatgaacgcggcgggctttgccgtggccatgccgacactgcagccggatgcgtttccgttctgggattcctgcctgatggtgctgtcgattgtggccatggtgctgatgacgcggaagtacgtggagaactggctgctgtgggtgattatcaacgtgattagcgtgatgatttttgcccgccagggggtttacgccatggcgctggaatatgccattttgacgttgattgcgctgaacggctcaaggatgtggataatcagcgcacgaaaacagggttctcgtgcgctgtctgctcagtgatgatgcgcgtgctcaccgtgctcgtgatggtggtgagcaccctcaattaccggcgtgttcagtgcgcaatccggtccgacacagggctgaaactccatctgtaccgtcgcatgttcaatctggtaatggtcgtgcaggtaagtgtgaatgcggcgcagcaggccgtcatgatcccgtggcgggataacctgcacgtgcagcgttaataccggcttctcgcctacctgccagacgtgcacatgatgaacatcgcgcacttcggcgatttgacgcttcagatcgcgtctgagctgattcacgtccagtgaatcaggtgcgccttccagcagctcgtgaaaactttcccgcagcaatgcccaggcgttacgcagtatcagcagtgacaccagaatcgataaaatggggtcagcgggcgtccagttcgtgagcagaatgatcaccgcggcaatgatggcaccaaccgaacccagcaggtcgcccatcacatgtaaggctgccgccctcacgttcaggttcttctcttcactgccgtgatgcagcagccaaaacgagagaatattagccagtaaaccgccaatggcgatgcccagcatcaggccgccggtaattggctgcggatgggaaaagcgctcaatggcctcccagacgatcagcagggtgatcaggatcagggcaatggcgttaacaaaggctgccagtgtggtgagccgcagcagaccaaaagtatgacgatcgctgggtttgcgtttagcgaactggactgccagtaaggccatcagcagcgcagcggcatcggtcagcatatgaccggcgtcggccagaagggccagcgagccagaaatccagccgccaatgacttctgccaccataaagagggccgtcacggcaaaggccgccatcaggcgcttacggttggtgtcatgaccgctatgagagtgcgtgtgtgccatatgtttccagtttgagtaataacctgtcggtcaatgatatcagcaattgccactcagcggagagagcctgatgttgcttcgccttgtccgacagctgctgacaaagcgttgccccttcttcaatacctatcaaaagccagcttcctttcatacggtgtgctgactcggctaactgcatagcgtcacctgcctgatgtgcggcgtgcagttgtgccaggtccttctccagggtatcacgtaacgttttgcccaggcggttaagaaatttctcgttttgctgcgccagctgccacaggttgtcatccagtgatgccagtggatcgtcatgaaaggccgtcagcacctcgccgatatcctgtagctgcaccggtttaatcagcacgcgttcatgctcacccaactgcacgttaagtaactgggcatcggctgaacacagcacccgtaactgcacgccgccgcgctgacgctggcgacgacgcaacaggcgcaacaggagcgtgccatcagggcgcggcatcatctgatcgataaacagcaggtcgtaagggcgctgcgcatcggccagcagcaggtcgcgaccctgttcaaaacaatccgcctgaatcgcgaagcgggcaagctgctgctccatcacgatcaggttcgtaggatgatcgtctaccaccgccacgcgcagaccaggaaagcccggcagggcagttggatcgctatccggaagccgatcgcaggggatcagcggcagggtgatggtcacctccgtgcctttgccaggcacagaatgcagggaaatatcgccacccatgcgttgcaccatctcccgacaaataaacaaccctaaaccgctgccctggaccgatacggttttacccgagggtgcctgataccagggatcgaacagtttaggctgctcctccggcgggattccgctgccgttgtcgctgacggttagctgtagcatgtccgtggccgatagcgtcagacgaatcaggccctggcgggtaaatttaaatgcgttggtaatgagattgttcaccacctgctgcaggcgatcggcatccatcatcaccgcgtcaggcagtggcgtgagggcttcaacctgcagacgcggaccgtccgggcgcatcaacggatgataaaaatggcgctgctgcgccagccagggggccagcgccagcggacgcggcgacagggtaaagctgttattttcaatacgggcgtgatcttgaagatcgttaagcagcgtcatcagtgactgcgcgctacggtgcagaagctgcagattttcactggatcgctgctgtttttccagctccagcaagcccagtatcgcctgcatgggcgtgcgcagctcgtgactgaccgtggctaaaaactggcttttcatggcgttggcgcgttcggcctgctcacgctgttggcgatcgcgccgctgctgccagtaacgtcgggcaagcagcagtagcaaaataatgatggcaacaccggccgccaccagaacggctaccggcaggacgcgcatggcggtaacgctgccaggctgaggtggcattgaccagcgatcgcgcatctgattttgtgtctcaacggggatctgctgcaacgcgcgatccagcagtgaacgcagtacgggttgatcggatgcgatgccaaccgcaatgggccaggcaatatcgctggcggcaaaggccagatgaatctgcggatcgttacgactggcaatccgccagcgcgcggaaagcacattatcgactaaggcgtcaatctgaccggctgccagcgcatcgtacaggctgtttcggtcaacataacgttgaacctgcatattctcagggataaggcgttgcgccaggtcatcctgcagaatacctatgcgcttgcccgccacatcgctccagtgcgaccagccagctggctggcggatataaatgccccacagcgcgcgccagacgggcaggctggtgctttgggtttcgccgttaagcggctgcatcagctgcaacataacctgatgctgagccagcaggctggcagcctgctgagggttactgacccagcgcggggtaaaacgtaatcctgtgctttgggcgatggcgttaagcaggtcgatcccgtagccgcgggcagtgccgttactgtcccggtaactccagggatagttatccgcttcagccgcgtaggcaacgattgggtggttcgtcatccactcgcgctcgctggcgctgagcatcagggtctgcgtgtcctgatagcggggaaggttgctgctccagcgcgcctgcagggtgctcatcagctcagcgggaagctggcgcaggctttgattcagccattcgataagcgccggatcgcgtgcgacggcgcgcaggttgagctgtccggcatcgataccggaggcaatctgataaatttgcccctgctgtaactggcttagcaagaaaccggcgctggtttcatctgccaccacataatcgttctgctgattcagcaacgtatagagcgcctgaagatcgctgccgtaggtgcgccactgatggcgggctgccagcgccggtggcagttgtgccagcgtgagttggctgattgccagttgggcattatgactgttgaacatcacggcacgctggttctgctggttacgataaatacgcaacgggctgctaaaccagctgtcactggccagcgtattcatggctaaaggcggggctatcattcccaacgcaaaatcaatctgtccgtcgtgcagcgcgcgcaataagtctgcctgagtggcatataaacggagcgtgaactgcgcaccagttaactgatgcagcgccgccaggtaatcggcatcgatgccataaaggtctttaccgaccagcatcgtccagggggcgttattctcctccagcagaccgactcgcagcactttgccctgcatcagctcagcacctttcaccggcatcatcatgggcaagttgatgctgctgaccgggcgcacgtcgccgtaggccagcgaggtaaagagcagcaggagcagcagccagcgtatcactgctgtgctttccacaaatcggctaactcaaccacagagtgggcaccggtcttttccaggatgttctttttatgggtgctgacggttttgttactgatatgcagtcgctcggcaatttgcaggttggataatccactggccagcaaagccagtatctgacgttctttactggttaacggcagttccggctcgtcgggacagtcggggaaggtggcatgtccaccgagcaccgccagaatcgcactcagcaactgctccatgcgctggctcttcaccacatagccagcggcacccagcgcctgggctcgcctgacgtagtggcgggtttgctgggctgaataaatcagaaccgggcagtcgggtaaatggattttcaggcggcgcaagatctccagcccgtcaccatcgggtaagccgatgtccagcacgataatatcgggtggcaattgcagaaaagggcgggcggactgttcgctgctggcggaaaaaagttgcatgagaatcggtgatttagccaacgcagcttcaagtgctacttcaaccagtggatgatcgtcaatcagaagcagtgaggccatgaacatttccctgttaatttaacaggctcagcatagcggaagttacggcaggataaaataaaggagagccaggctctccttatcaactcaaccgtccggtcttactgcgtggtgccgtcggttttggtattaacgtgaccgccaccttttttggtatgaacttttttattcatatcagggcatttgccgtctttacactgggtattcttatcaatctcgtcagccgtcatatgtttgctgctggacgtgctgtcagcggtcggagacgatttctcggtgcctgtgttattaattttgctgttatcgactttgttcggtggcaggttctcgttagcaccgccagctactgcgcctgcggcggcggcctggttagagtttccgttagcagccattgctgcgccactgcccagagtcattgctgccgtcagaaaaattattgcaaacttattcatcattatgctcccgttaataaatgatatttgctgtctctaacccgctgcgatgtttggttcagagaaaaagcgccctgagcgaaataaaatttcgctggttagcttaaagacaggtattaataaaagtaagccaccgttcctcagtggttacctttaaaagtctagacgcataacccatttatgcaaatttcacgcatacattatacgttcatcaggaatttacaccccgtgcgcttcgggctacattggctgggttgtgtccggcgggcgccgggccagaaattatatggaatgagtatgaattaccagaacgatgatttacgcattaaagcgatcaaagaactcctgccacccgtagccttactggaaaaattccctgcaaccgaccgcgctgcgcagaccgtttcgcaggctcgccaggcgattcaccagattctgaaaggggaagacgatcgtctgctggtggtgattgggccttgctccattcatgataccgaagccgcacaagactatgctgcgcgtctgttaaccctgcgggaacagcttaagggtgaactggaagtcgtgatgcgcgtttacttcgaaaaaccgcgtaccactgtcggctggaaagggctcatcaacgatccttatatggatggttccttccagttgaacgacggcctgcgtctggcgcgtaagctgttggtagagattaacgattctggtctgcctgccgctggcgagtttttggacatgatcacgccgcagtacgttgccgatctgatgagctggggcgcgatcggcgcacgcaccaccgaatcgcaggttcaccgcgaactggcttctggtctttcctgcccggtcgggtttaaaaacggcacggacggcaccatcaaagtggcgattgatgccattaactccgccagttcaccgcactgtttcttgtcagtcaccaaatacgggcactctgcgatcgtggaaacccgcggcaacggcgactgccatattattctgcgtggtggtaaagaaccgaactacagcgccgcgcacgtcagtgcagttaaagccggtctggaaaaagccggtttaccgcagcaggtgatgatcgacttcagccatgccaacagcagcaagcagtttcagaaacagatgctggtggcagatgatgtggcgcaacagatgatcaatggcgagcgcggcattatcggcgtgatgattgaaagccatctggttgaagggaatcagagcctggaaagcggcgaaccgctggtatacggcaagagcgtgacggatgcctgtattggctgggacgataccgagaaggtcctgcgtcaactggcccatgcggtcaaacagcgtcgcggttaacagggcgcaataaaaaagggccagacagtgtctggcccttttcacagagaagcaaaacttacttcgctttaccctgattcgctacagctgcggctttagctgcgatctcgtcagcatcacccaggtagtagcgtttgatcggtttgaagttttcatcgaactcataaaccagcggtacgccggtcggaatattgagttcaagaatctcatcttcgctcaggttgtccaggtatttcaccagggcacgcagtgagttgccgtgtgcagcaacaatcactttctcaccgcttttgatacgcggcagaatggattcgttccagtaaggaatgacgcgttcgatggtcagggccagactttcggtggtcggcagctgctcaggcttcagtgaagcataacgcgggtcgtgtccagggaaacgctcatcgctacgatccagctctggcggggttaccgcgaagccacggcgccactgttttacctgctcgtcgccgtatttggcggcggtttctgctttatccagaccctgcagcgcgccatagtgacgttcattcagacgccaggatttctcaacgggcagccaggcctgatccagctcatccagcacattccacagggtgtgaatggcgcgtttcagcacggaggtgtacgcgaaatcaaacacgaaaccttctttcttcagcagctgtccggctgctttagcttcggtacggcccttgtcagaaaggtctacatcataccatccggtgaagcggttttcgttgttccactggctttcgccgtgtcgcaccagaaccagcttagttacagccatagcttaactccttaatacttgatgtttctgagataatggaaacctgctgtcgccagcccgttggctgaccaattgcgttctaccatagcggaaaacagcgcactgcgtaagtctgtctgtgacgcactgcgcgtttttcacccggttgctcagcgtggcgtaaagcgatagcgcgtgacggattcccaacgatctcccggctgtaaccagcaatcatcctgtggccactcgggatgattaggtgaatccggtaaaaattcactctccagcgcgatcccctgaaacgcagtatagcgttcctgctcccgggcgcgcgtgccggccaaatagttaccgctgtagaactgcaatgccggcgccgaggtggtgacgcttaactgcagtttaccgtcctgcgaccacaactcagcagcaggctgactgtcatcgcctgcgctgttgagcaggaaagcatggtcatagcctttaaccgccttctggtcgtcatcggcaagaaaatcctgctcaatgcttttggcctgacggaaatcgaaactggtgccgtccaccgccttaagtggtccgttgggaatcccctcgctatccacgggcaggtaacgatcggcgtgcagttgtaatcgatgctgacgtgcatcgccatgatgcgcgtcaagattaaagtaagcatgattggtcagattgaccgggcagggctgatcgcactgcgcctgatagtgaatcgacaggcaattatcgtcatccaggacatagcgtaaatcagcaataagattgccgggatagccctgatcgccatcgggcgagtcgagtcgataatgcacttcactttctgactggctgacgatttgccagcggcgtttatcaaacccctcagggccaccgtgtagctggtggtcgccctgattcgcggccaactgccggcctgttttagccagttttgcgctggcgatacggttagcataacggcctaccgtggcacccagataggcatcctgatgcaggtaatcggaaggcgttgcgcagccaagcaatgcttcacgtacgtgaccatcctgcaacggcacccgcgccgataaccaggtcgcgccccagtccataaaggtggcaatcatgccattggcattgcgcagcacggtgatgcgccacggctgaccgtccggcgcatgggaattgacatcgcttaacattggcctgctccttctgatgctttacaaacgtagaaggtctccttgatgcccgttttggcttcatactggctggcgacggcggcctgcacctgatccaccagctcaagcggcatcaaagcaacaatacaaccgccaaaaccgccgccggtcatacggacaccaccacgatcgccgatctcggctttaacaatctcgaccagcgtatcgaccggtggcacggtaatttcaaagtcatcacgcattgatgcgtgagattcggccatcagttcgcccatgcgtgctaaatcaccacgagagagcgcctcggcggcctccagcgtacgggcattttcggtgatgacatgacgtacgcgcttagcgacctggggatctaactgagattccgcggcgttaaactcagcgagttcgacatcccgtagcgcctttttgttaaagaagcgcgcgccggtttcacactgctcacggcggacattgtattcgctgcccaccagactccggcggaagttggaattaatgataaccacggcaatatcgtccggcatagaaaccggccgggtgccgagcgtccggcaatccagcagcatggcatgatctttttgacccagcgcggaaatcagctgatccatgatgccgcagttacagcccacgaactggttttcggcttcctgaccgttcaccgcaatcgccgcaccgtccagcgccaggttaaacagctgctggaaaaccgtcccgacagccacttccagcgaggcagaagagctaaggcccgcaccctgtggcacgttgccactgatcaccatatcgacaccgctaaaatccggcgcgcgttgctgtaaatgcttcacgacgccgcgaacatagttcgcccacatgggttcttttacgctggtaatcggcgcatccagcgcaaaggtgtcctgcgcctgatcgtaatcgacggcgacgacacgaacctggcggtcgtcacgcttcgcacaggcgataaccgtttggtaatcgatggcacaaggcagcacgaaaccgtcgttgtagtcggtgtgctcgccaatcaaattgacgcggcctggggcctgaatcgcgtgggttggcgcatagccaaaggtttcagtaaaaacctgctgcgtgatggtttttaagctcattgttgtgcctcacggaaatgaatatcgctcacggaacgcaggcgttctgctgcctgttctgtggttaaatcgcgttgggtttcagccagcatctcgtagccgaccataaatttgcgcaccgttgctgaacgcagcagcgggggataaaagtgggcgtgcaactgccagtgttcattgtcttcaccgttgaacggcgcgccgtgccagcccatggagtaggggaaggagcactgaaacaggttgtcgtaacggctggtcaggcgcttgatggcgttagccagatcgtcacgctgcgcatcggtcaaatcggtcaggcgcttaacatgggtttttggcaacagcagggtttcaaacggccaggctgcccaccacggcaccacggccagccagtggtccgtttctaccacggtacggctgccatcctgctgttcacgcgcgctgtaatccatcagcatcggcgagcccttttgggcaaagtagcggcgctgaagatcatcttcacgctgggcttcattaggcagaaagctgttggcccagacttgtccatgtggatggggattggagcagcccatggcggcgcccttgttctcaaagacctgtacccacgggtagtgctgacccagttctgccgtttgttgttgccaggtgcggacgacttcttccagtgcgctcagggacatttctggcagcgttttactgtgatcgggcgaaaagcagatgacacggctggtaccgcgcgcgctttcgcagcgcatcaacatgtcatcactttctggcgcgtctggcgtatccgtcatcaaggccgcgaagtcattggtaaaaacgtaggtgccttgataatcaggattcacatcacctgtgacacgcgtgttgcccgcacacagaaaacagtcagcatcgtgcgacggcagcgtattcaccgcaggcgtttcctgagcaccctgccagggacgtttggcacgatgaggagaaaccaaaatccactggtcagtcaggggattgtaacggcgatggggatgatcggccgggttaaatttttccatgttgcatcctggtcagcgtcaaaataaaaaaaggcatcgctaaaacgtagcacatcagccgcgttgaaaacgtgatccagcctggataagtggtatcgtttacacaagctgaatattcttatttaaaggcgaagtggcacatttcgcacataaaaagtgggtttaaatggtaacgcttacattgtaggggaaacaacgccggggtgacggcgttgataaggtcaaacgctgtcctgccggtagcgataaccgccttcgggctgcgccacaaaatgcagccggtgagtaatacattggggggcatcttccgcatggtgggacacgaacagcaactgggttcgtccttcaccaattaagatatcgacaaaacgtcgcactaactgacgattaagcggatctaatccctgtaatggttcatcaagtattaacagggtaggatgtttaaccagcgcccgggcgattaacaccagccgttgttgtccccaggataaaccatggaagggcatatcgcccatcgctgaatccatacccagcagcgccagccactgacgcgccagggccatttgtcgatcggagacggcctgataaagcccaatagagtcaaaaaagccggataaaatcacggtgcgcacgttggcgctcacccggtaatcaagatgcaggctgctgctgacataaccaatatgttgtttgatatcccagatggtttccccactgccacggcgaaggccgaacagagttaaatcattgctgtagccctgcggatgatcgccggtgaccaggctgagcaatgtcgatttacccgcgccgtttggcccaataatatgccagtgctcaccagcattaacctgccagttaagcccgtcaatgatgcgctggtcgttataggacaccacgccgttacgcaggatgacccgtggcgcattatcggccaactggggaagtgcatccgcgacatcggcctctggcagtgccatcccgtccaactgctcactgcgtgccagctgtgcgaccagcgcctgcgccagaatcgcctcgcgcggcccgacgtgcgtcaggctgcattcggccagaacgccaacctggtcaacataattcggaatatcgtcaaagcggttaagcaccagcaccagggtaaaatccgcctgctgcaggttattcagggtggctgtcaggttggcgcgtgaatccacatccagaccgtcaaaaggctcatccaggatcagcaggtcaggctgcttcattaacgcctggcacagcaacgttttacgcgtctcacccgtagacaggtatttaaaacggcggttaagcaggccggtgataccaaactgcgccgccaggtgttcacagcgcgtcctgtctttgacctcatcctgaatgatttcagccgtggtgcggccggtgtcatcctcaccctcactcaacagatcggtattatttcgttgccattcatcggcgaccagctgttgaagttgctccagagacaggcggctgggacgctggaaatcacgcgtaacctcacctgacagcggcagtagctcacctgacagggcgcgggccagcgacgatttgccgctgccgttggccccaacaaaggcccagcgttcaccgcgttgcagatgaacatcggccagagacagcacccgggtatcattaagatgaaatatgccttgcgaaatttgcaatgaagccatgattcgttccattttttgcagcgttaaccgttgttttagccactgcatcggatgaagtcaaaccaggataacagatcaacgcaacgacgcgacgatggcatggctggcgctgaagctggcgatcacggcgttgccgggctgccactgccgccgttcgatttcactgttatccagcgtggcgcacagcgtttcaccgcctggcaggcgcatcaggacttcactgacctgctcgccacgctcgatagcgcttatcgtggcggcaagctgattctccgcctgagtgggttgagtatgaaggctgatccagggggctttgatcagcaccagcacctctttaccgctcttgagctgcaggcgttccgcactgcgctcggtgagggcgaccttgagccgggttaggccgtcggagagcagaatggtcaggtgctgcacaacgtgctgtgcgtcgttgtctgttaccgtgccaaacagttgattacgcgcgctggtttgcaacgaggcgcgggcaatagcggccagcaggctgtccagcggcaggctatcctgctgcaaagcatcaaaggcatattgctgaatcttttccatcaaaccaaacagctgtaccaggcgctcgccatagcgggttaactgcgcgccaccgccgccttttccgccggttgcgcgcgccacgatttcctgttcagccagctgattcatctcgttgatggcatcccaggcgctcttgtaactgatgcccgccagtttcgccccctggctgatcgaaccggtttgctgcacgcgttttagcagttcaatgcggcgtggatcggcaaacagtttttgctgcaggcggatatgaagggtgagttcggcttgcatggtggctccggcaaagagtgaatcgcgttatcgggcagatgatagcgagctttccgtctcaaagtaaaagcacgaaaaggactgcgcaaaattttactgagccgttacaatcccatctttatacgcaaagtgggactttccatgctggaacttattaaaagcctcgccgtggcggtgatcatggtacctgtggttatggcaatcatgttaggcctgatttacggcctgggtgaagtgttcaacctcatctctaaaacgggtcgccgcgacgataacaagacccgctctcagcattaattctcctgcaacgtccgcctcagcgcggacgttgtggtttttaccccgcatcacgtctcctctccgcttttgctaatttggtcctggtgtcagataatgcgttgtattatccgatatataacgatcactggagagaaatcatgcgtttcgcattttatcgtttgagtatggcggcagtattgacggtttccctgagcagccaggcgctggccgccgaaaaagttactgtttttgccgccgcttcattaaccaacgcgctggaagagatagccgcacagtacaaaaaagcgcacggcacggaggtggtgtcatcttttgcttcttcttctgtgctggcgcgtcagattgagcagggcgcgccagccgatctgtttatctcagccgatcagcagtggatggacgatgccgttgccaaaaaaagtatgatcgacaccacccgttatacgctgctgggtaatgatttggtgctgattgcaccgcgcagcgacggtgccaagccggtgacgattaacgataacaccaactggaaaagcctgctgaaaggtgaacgcctggccgtgggcgaccctgatcatgtaccggccggcatctatgccaaagaggcgctgcagaaactgggtgcctggtcttccctgtccccgtcactggcgcgcgccaataatgtgcgtgccgcactggcactggtcgagcgtaatgaaaccccgtacggcattgtttacggctcagatgctgtggccagtaaaaaagtccaggtggtgggcacctttccggaagacagtcacaaaccggtcgaatatcctgtggcgattgttaaagatcgcgacaacgcggccgttaaggctttctataactacctgaaagggccggaagcggccgcagtgttcaaacaatacggattcacgcctaaaaaatgatactcagcgatgttgaatggcaggcggtcatgctcagtctgcaggtgtcaggcatagccgtgctgtgcagtctgccattcggtatcctgatggcatgggtgctggtacgttgccgcttccccggcaaagccatcctcgacagtgtgatccacttacccctggtgctgccaccggtggtggtgggttatctgttgctgataggtctgggccgacgcggtatcatcggtgaaaaactgtatgactggtttggctttagcttcgcgttcagctggcgtggagcggcgctggcctcggcggtgattgcctttccactcatggtgcgtgccattcgtctggcgctggaggcggtggatatccggctggagcaggcggcgcggacgttaggtgccgggcgctggcgggttttttttaccattacgctgcccttaaccctgcccggtatcatcgtcggtacggtgctggcctttgcccgttcccttggcgagtttggtgccactatcacctttgtgtctaacattcctggcgaaacccgcacgattcccctggccatgtatacgctgattgaaacaccgggtgccgaaggcgccgccgcacgtctgtgcgtgatcgcgatcgttctggcgctggcctcgttactgatttctgaatggctggcgcagtggggccggaaacggatgggctcctgatgctgacgcttaattttgctcaacggctgggcgaacaccagcttgagattgacgtgacgattcccgccagcggcatcaccgcgatattcggcgtatccggtgcgggcaagacctcattgattaatgccatcggcggcttaacccggccccagcgtggacgcattcagcttaatgaccggatactgttcgatgcagaacagcaggtcgccttgccgccggaaaagcgcaacattggttatgtttttcaggacgcacggctgtttccgcactacagcgtgcggggcaatttacgctacggcctctcggccagtatgaaaagccagttcgattcgctggtggcgttattaggccttaaccccttactgaaccgtttcccgctgtcgctctcgggcggagaaaagcagcgcgttgccatcggacgcgccttgctcagcgcacccgacatcctgctcatggatgagccgctggcgtcactggatttgccgcgtaagcgtgagctgatgccttacctgcagacgctggcgaagcaggtcgatattcccgtgttgtatgtttcccatagcctggaggagatactgcagctggcggataacgtgctggtgctggatgcgggaaaggtaaaagcctttggtcccctggaacgtgtctggagcagcagcgcgatgcggccatggctgcccgcaagcgatctgaccagcgtgctgcgtgtgcaggtactggagcatcatccggactatcccatgtcggcgctgtctctgggcgatcaacatatctgggtcagccgggtcaatttgccggttaaatcgccgttgcggatacgcattgcctcggcggatgtttcactgacgctgcaacccgcgcaaaacagctccatccgaaatgtgctgcctgcgcaggtcgtcgagcttattgaggtaggcgatcaggttgaagtgaagctgcgtattggcatcagtgagctgtgggcgcgtatcacgccctgggcgcgcgacgagcttaatatccggccccaacagtggctgtatgcgcagattaaaagcgtgtcggtcacgacctgaggtgcccggtggcatgttgttccaccggggcagacatcatgacaggacgtgctgataaagcgtgtcggcgataccggtttcaaggttggtgccagtcaccatttttgcccgcgacttaatgacgtcgtccgcattgcccattgccacgcccagcccgacgttttccagcatgctcaggtcgttgtagttatcgccaaacgcaatcacgtcgtccatcgtcagccccacagactcgacccactgcgccaggcgcttccctttgctgttgccgccgcgcgcaacgtcaacctgatcgtgccatgaccactcgcaggccagccccagttcggcttctgcgcgctgggcaaactgctgcagttctgcggtgttctcgtgggaaagggcaaacttccagatcgactgcgcctctttggcggcctgcgccaggctgtccacctgcgtaaatacggggcgctggtgcggcgggagcgactcactccacttcagcgtgcgaatcacatgaccggtcggagtttgatacagcatcgcatcgtccacatacagcaggccgtgaatctgatgttcgtccagcatctcaatcacgcgtagcgcaacctgcgcatccagcgggtcagaagccagcacttttttggcgggatagtcatacagataggtgccattacagcagatggcgggtgtatccagatttaaggcctgatagaaaggatgaatggcgcagtggtgacgtccggtcacgataatcaccttgacgccagccttgcgcgcttgcgtaatcgcttccacggattgtggcagaatggttttcgtcggggtcaacagcgtgccgtcaaggtcgagggcgattacacgatagctcattaatcctctcatcggaatgggttagcagagcagcaagtctacacccgacctgggtacggaaacaaaaatcagggcacaaatcattcctgcgagacagaaaaaaacgcgctacagtgacctgcagaacaacatgagtcagcgaaaaaggagaatacatgaagcaagttgtctacaccgccagtcctgagagtcaacaaatccatgtctggcagttgaatgaagatggcaccttgacgctactacaggttacggacgttgcgggtcaggttcagcctatggtggtgagtccgaaaaaagatttcttgtatgtaggcgtgcgtcccgacttccgcgtactggcgtttcgcatcgccccggacggcacgctgaccgaagccggacaggcaccgctgccgggaagcccgacccatatctccaccgaccatgctggccggttcctgttttgtggttcctataacgatgcgtgcgtcagtatcagcccaataggcgaagacggcgtgccacaggcaccgagccaggtgattaacggtctggcgggatgccactccgccaatatcgacaatgccgatcgcacgctgtacgtacctgcgctgaagcaggatcgcatctgcctgtttgatcttggcgctgacggtcagttaaccccgcatgcacaagagcaggtcacgacggcggaaggggccgggccgcggcacatggcgtttcatgccaacggacagtacgcctacagcgtcaatgaactcaacagcacggtcgaggtctgggcgctgaacaatgcgcatggcaaggtcgagtcggtgcaaacgctggatatcatgccgccagattttaccggtacccgctgggctgcggatattcatctgacgccagatggccgtttcctgtatgcctgcgatcgcaccagcagcatgttaacggtgttcagcatcagcgaagacggcgccgttctgacgcgggaagggttccagcctacggaaacccagccgcgcgggttcaatatcgatcatacgggtcagtacctggtggcggcagggcagaagtcgcaccacattgaggtgtataacattacctcgccacagggattactgaagccggtaggccgctacgccgttggacaaggtccaatgtgggtggtggttcatcaactggcagggtaacgttcaggatggccgcttccggtaagacgtttaaccggaagcggcattgtcaggcgacgatcagacgtaatgaacagttaacgctgcgctggctaacacgtgaaagtgcacgttaaacccaaccatcgcgccgctggcaccctcatcaacctcgattttatccacatccagcgcatgaacgctgaaggtataacgatgggtttcaccggcgggtggtgccgcgccgccgtagccagcctggccaaaatcggtgcgtgtctgcagcgcgccggctggcagcgcggctttaccggaacccgctccctgcggcagcgatgtcgtgtcggccggaatattcgccaccacccagtgccaccagcctgagcctgtaggcgcatccggatcgaagcaggtgatcacaaaacttttggtgccctctggcgcgtcttcccaggccaggtggggtgaaagattatcgccctgataacccattccgttaaaaacgtgtttttccggcattttgtcgccgtcatgtaaatcctggctgtaaactcgcatcacatctccttgcgttaatggtcactgccttttcatcttaaccaaaagccggtttacgtccagccgttgaaacattaagaaagaaagtgtgccggcttctcaagcgccgcacctatcgcattgaccagcgcattcagcgcctcaggcgtgatgatataaggtggcatcagataaatcaggcgaccaaagggccgaatccagacgccctggctgacaaaaaattgctgtaaggctgccatgttgaccgggcgatgggtttcaacaacgccaatggctcccagcacgcgaacatccgcaacttcgggggcatggcgcaggggcagcagcgtgtcacgtagctgacgttctattgcggcaacctgatgatgccagtcgccttcctgcactatcgccaggctttctgttgcgacagcgcaggccagcgggttcgccataaaggtggggccgtgcataaaacagcccgccggactgtggctgatggtatcggccacctcccgcgtcgtgagggtggcggccaggctcatggtgccgccggtcagggcttttccgacacacatcatatccggcgtaatcgccgcatgttcgcaggcaaacagcttaccagtgcggccgaagccggtggcgatttcatcggcgatcagcaggatgccatagcggtcacagcattcgcgcacgacctgcaaatagcgcggatgataaaaccgcatcccgcctgcgccctgaaccacgggttccagaatcaccgccgccaactggctctgatgttgctggatcagccggacaaaatcctcagcatcgcgcgcctcccactcatcatcaaacccgcactgcggtgcttcagcgaaatggtgctcgggcaggtagccgcgccacaggctgtgcatggaattatccggatcgcataccgacatcgcggcaaaggtatcgccgtgataaccccgtttgagcgtcagaaactgctgacgtgtttctcctcgccccagccagtattgcagcgccatcttcatcgccacttcgacggcaacggagccggaatccgccagaaacacgcactccagcgcgtctggcgtcatggtgactaactggcggcaaagggccacggcggcaggatgggtaatgccgccgaacatcacatgggacatctgcgccatctgctgttgcagcgcccgattcaggcgcggatggttatagccatgtatcgccgcccaccatgacgacatcccgtccaccagctcgcgaccatctgccagttgcagatggtaatcccgagccgcaacaaccggatagcagggcagtggctgcgccattgaggtatagggatgccagatatgctggcgatcaaattcagcgtcctgtggagtaaacattggagttgtaaaccaaaataaaaagatttagtttacaagtataaccacgttaactgtcgggatgacaccttttttggagtatgtaatgtcacaacgttggactatagcccaggcacaggcgctgttcgatcggccttttcttgaactgatgtttgaggcacagcaggtgcatcgccagcacttcgatccccgtcaggttcaggtcagcacgctgctgtcgatcaaaaccggggcctgccctgaagactgcaaatattgcccgcaaagcgcccgttacaagaccggtctggaatcggagcgcctgatggaagtggatgaggtactgcgttccgcgcaaaaggccaaagctgccggttcgagccgcttctgcatgggtgccgcgtggaaaaaccccagcgaccgcgatatgccttacctggaaaaaatggtggaaggcgttaaagcgatgggcatggaaacctgtatgacgcttggcacgctgagcgacagccaggcccagcgtttaggcagtgccggacttgatttctacaaccacaacctggatacctcgccggagttttacggcaatatcattactacacgtagctatcaggaacgcctggatacgctgggtaaagtgcgccaggcgggcattaaagtctgttccggcgggattgtgggcctgggtgaaacggtgaacgatcgcgcgggcctgctggtgcaactggcgaacctgcctacgccgccggaaagcgtgccgatcaacatgctggtgaaggtcaaaggcaccccgctggcagagaatgatgacgttgaacccttcgactttatccgcaccatcgccgtcgcccgtatcatgatgccgacctcgcatgttcgcctgtcggcgggccgtgagcagatgagcgagcagacccaggcgatgtgctttatggcaggtgcgaactccattttctacggatgcaaactgctgactacgccgaacccggaagaagataaagatatgctgttgttccgcaagctggggctgaatcctgaacatacccagactgacaacggcgacaatgcacaacagcagcagctaacggagcaactgcttcacgccgatacagaaaaattctataacgcggcgctgtaatgagctggcagcaacgcatgcagcaggcgctgacgcagcgccgggctgaagatggctggcgtgaacggcgggtgattgaggagaaccaaacgcgcctgatccgccatgccggtcagatgtatcgccacttttccagtaacgactatcttggactgagccagcatcctgccgtgatcgcgggctggcaacagggcgcggcgcaggcgggagctggcgcgggcgcatcaagccatgtcactggctatcatcggctccatgccgagctggaagcccaactggcggactggctgggctatccgcgcgcactgctgtttatttcgggctttgcggccaaccaggcgatcattcacctgttagccgagaaaaatgaccgcatcctggccgataaactcactcatgcttcgctgctggaggccgccagccacagcccggcgcagctgcgccgttttgcacataacgatccacagagcctggctgcccggctggatgcgccctgcgaggggcaaacgctggtggtcaccgaaggcattttcagtatggatggcgatagcgcgcccttacaggcgattgctgctcaggcgaaacaggcccgcgcggggttgctggtcgatgatgcgcacggcattggtgtcaccggcgaacaggggcggggcagttgctgggcgcagggcattaaacctgacctgctggtggtgacctttggcaaagccttcggcgtcagtggcgccgcgttgttgtgtgatgaggctaccgccgattattttcagcaattttcccgccatctgatttactccaccgcgatgccgccggcccaggccagcgcgctgttagccgcgcttaaacaggtgcaggtgggcgatgaatatcgccaacgtcttgctcacaatatcgcccattttcgtcgcggggcagcctcattgccctgggcgctcatggattcgtccagcgcgattcagccgttgatcgtcggcgataacgggcaggcgctggcgctgtctgcgcgcttagcccgtgcgggctgctgggtcagtgcgatccggccaccaacggtgccaccgggtacagcgcgtttacgtattacgctgacggccgcccatcagccagacgatattgacgtcttaatggaggcgctgcatgacgctgcaggttgataaacgcgccgttgccagagcctttggtcgcgcggcctcccagtatgatcaccatgccgaactccaacggttgagcggtgatgcactgctggcgtgggcacccgcgcacactggcctgcaggtgctggatgccggttgtgggaccggctggtacagccggatatggcacgagcggggcaaacaggttaccgcgttggacctgtcggcgcagatgttgcaccaggcccggcaaaatggcgtcgcgcatcactatctggcaggggatatcgatgcgctgccgttggcaaaccagtgcattgacctggtatggagcaacctggtggtgcaatggagcgaagatttgcagggggcgctaacgcagtttaaccgggtactaaagcccggcggctgtttgctgttttccaccctgagcgcgggctctctgcacgaagtccatcaggcctggtcgcacctggatggcagcctgcacgctaatcgcttcctgcccgcacaggagattgccgccgcctgtgaagctcagcatctgcactgccatgcacaaacctttatcttgcatttccccgatgccctcagcgcgatgcgatctctgaaaggcatcggggcaacccatttgcatagcgggcgatccgcctgtttgttgacgcgtcaacgtcttgctcaactcgaagcccactggccccgggatgagcagggttttcgcctcagttaccatgtgatgtttggagtgacgaaatcatgaaacgctggtttgtgaccggcaccgacaccgaagtcggtaaaacggtggccagtgcggcgctgctgcaggctgccacggctgcaggttatcgttgtgcaggctataaacctgttgcctcgggctgcgagttaactgcgtcaggcgtgcgtaacagcgatgcgctggcgttacagcgttacagcaacgtcgcgctgcgctacgagcaggtgaatccactggcgtttatggagccaacctcgccgcatatcgtcagcgcggatgagggcagaccgattgagtttgccaccctgtcggcggggctgcgtgaacttgagccgctggccgagtggattctggtcgagggagcaggcggctggtacacgccgctttctgcgacgcaaacctatgcagactgggtagaggcggagcaactgccggtgattttggtggtgggcgttaagctgggatgtattaaccatgccatgttgacggccgatgctgtccgcgcacgcggtttgcgactggcgggctggatcgccaatacggtacagccgcccggtcggcgctatcaggaatacctcacggccttaacacagcgccttccggcaccttgtctgggtgtgattccctggttaacggatgaggaccagcaggctgactgtggtcagtacctgacgctgcctggcgaatcaggccacggttaaccatttatccagggtaccgtcatccaactgggtgacgttgccctgagccacattgcggccgcgatgcagcagtaaaaagttgtcagccacacggcgaatcaatgaaacccgctgttcaagcagcaaaatcgtcaggccgtagtcgcggttcaggcgacgaatcagattccccatctcttcttccagccagggtgccataccgtcggcaggctcatccagaatcagcaggcgcggctgtaagaccagcgcacgggccagcgccagttgctgctgctgatagacgggcaaatcgccgctacgctgttgacgcaacgaataaagcgccggcagcaggtcgaatatcatttccgggatagcccgatagccgtcatgcggttgtgcgcctgccagtaaagcaatgagtaaattatcctcgacgctcatctgagtaaaaatatgtcgcccctgcggaacatagccaatgccctgacgggcgcgcagctctgcaggctgcgacaacaggtcttcaggcggcgaaccatcctgctgccagctaatggtcccgctgtttataggcagcttccccataatgcagttgaccagggtggttttccccatgcctggccgtcccagtatgccggtgcaggtgccgggaggcaggtccagatccacattccagagaatatgatttttaccgtaaaactgattcaccgaccgtaaacttaacatctgacgcgctccttccagataattaacctgaatgctttcgccgttcatctctggtaaatcgctctaatgagatagcgggatcttcaacaccgctattgcctgtactacgctggtaaaacgttatgcaattcccaggccagagtcattattgccccctgtggctggcttaacctgcggaaataccatcatttaaagataaagaaaaatgaacaataccagccttagcttaaggcgcggtgcaacggcggtgcaggcgaaaggcgtgatgaagtgcgtctgctcgctaatggggcaggtgccagaccacaaaaaataaaaaaagaaaaggggctgtcgcagatcaaggcaagcgccgctgcggtagctcaatcctgccagttagtgtcagaaattaagcgaaaaaaaattttttttagggccgccatgacgacgaaaaaaattatacacagctgatgtgcaaagggctgtcatcagttatccactattcctgtggataaccttgtgcattagataatgaaaacaggttagaagcgaggaaatacggggcctggtaactggatgatgagaatctgggctttttaaagtagcggctataaatcaatgggttatcaaaaaacaagcctgccggattggtgccgattcatcaaactgcaattttatgacacatgcttgacaaatgttaaatcagggcctggcttggggataacctggcgcaacaaaaacagctgacagcaagggataaagccaaagagtcaagcggaaagtgatgtccgttactgtgcatcattactgttattatatccagtatttttttctggcaaaatcggcatagcagagtaaaataatgggctgcccgccgtctttcttctgcaggaaccgtattcatgagtaaagattttaaactgaactccgctttcaagccttctggcgatcagccggaagcgattcgtcgtctggaagccggactggaagatggactggcgcaccagacgttattaggcgtcaccggatcgggtaaaacctttaccgtcgctaacgtaatcgccgatctcaatcggcccaccatggtattagcgcccaacaaaaccctggcggcgcagctgtatggtgagatgaaagagttctttccggacaacgccgtggagttttttgtctcctactacgattactaccagcctgaagcctatgtgccgagttccgacacctttatcgaaaaggatgcctcggttaacgaacacattgagcaaatgcgtctttccgccacaaaagccttgctggagcggcgcgatgttatcgtcgtcgcatcggtgtcggcgatttatggcctgggcgatcccgatctttatttgaaaatgatgctgcacttaacgcgcggcatgatcatcgatcaacgcagcatcctgcgccgcctgtcagagctgcagtacacccgcaacgatcaggcgttccagcgcggaaccttccgggtgcgcggcggggttatcgatgtgttccctgcggaatccgacgacattgcgctacggatcgaattatttgatgaagaggtggagcgcctgtcactgtttgacccgctcactggccaggttgagtcagtggtgccgcgctttacgatctatcccaagacgcactatgtcacaccgcgtgagcgcattttacaggccatggaagacatcaaagtcgagctggccgaccggcgtaaaaacctgctggaaaataacaaactgctggaagagcagcgtatcacccagcgtacccagtttgatctggagatgatgggggagctgggctactgctccggcatcgaaaactactcgcgttacctttcgggccgtgggcctggagaagcgccgccgaccctgtttgactatcttccggcggatggcctgctggtggtggatgagtcccacgtgacgattccgcaaattggcggcatgtaccgtggcgaccgggcgcgtaaagagacattggtggaatacggtttccgtctgccctcggcgctggataaccgcccaatgaagtttgaagagttcgaggcactggcaccgcaaacgatttatgtatcggcgacgccaggcaaatacgagctggaaaaatccggcgacgaggtgattgaccaggtggtgcgaccgaccggcctgctggacccgatcctcgaagtgcggcccgtcgcgacccaggttgacgatctgctgtcagagatccgcaaacgcgtcaccgtcaatgaacgcgtactggttaccgtcctgaccaaacgcatggccgaagacctgaccgagtacctggaagagcacggcgaaaaagtgcgctatctgcactcggatattgataccgtggaacgtatggaaatcatccgtgacctgcgtctgggtaaatttgacgtattggtggggattaacctgttgcgagaagggctggatatgcccgaagtgtcgctggtggcgattctggatgcggacaaagagggcttcctgcgttcggaacgctcgctgattcagaccattggtcgtgcggcgcgtaacatcaacggtaaagcgattctctatggcgataaaatcacaccttcaatggcgagggcgattgaagaaaccgatcgccgccgtgaaaagcagcagcgccacaatgaagaaaacggcattgtgccgcagggcctgaataagaaaatcaccgatatcctggagctgggcaataacgtggtgaaaacccgcggcaaagccaaacccagcaaacgcggtgcggccgaaagcaacgccgattacctggcgttatcgccgcaggcattgcagaaaaagattcacgagctggaagggcagatgcagcaacatgcgcaaaacctggagttcgaacaggcggctggcctgcgcgatcaactgcaagaattgcgcacgttatttattgcggtgtcgtaattcagttaaacccctgaatagcgtgttccagcgctgcgcggagcagctggcggtcgtgacgatacttgatatcggccgcctccagcggttcacgaataatcaggcggttttccacccggctgacatctgtggacgggccaaccacgatggcgtcaatcacccgcttgccaatgtagtgttccatcatcgccagtttatcggccacggtaagtgtggctgccgcaggactcaactcccggcccagattgccgataaacaccatattggcgggagtgcgccgtaacgcctgggccatctctttcatgagcaaaatgggcatcaggctggtgtaaaaactgccaggcccaatcaggatcagatcggcctctgcaacggcgtcgagcgcttcccgggtgggttgtacggcagggtgcagcatcagttcctgaggcggaagtttcatctcgtcgatggcggtttcaccgtaaacggcattgccctcgacatcggttgccactaaatcaaccggctgttcagacataggaattaaaaaggcgtcgacctttagcaggtttcggatgatgttaaccacttccagcgggcgtacgctaaggtgatccagcgctttgagtatcaggttgcccaggttgtgtccggccagttcaccgttgccggtaaagcggtattcgaacatggcggatgccacgctcggctcggtaatcaactggttaatacagttacgcaagtcgccccaggcaataccgccttcggcgcgacgaatgcggcctgtggagccgccgttatcggtggtggtgacaatgcctgtcaggcgtgaacccaggggagacagggcagacatcacgcgtcctaatccgtgtccgccccctaaggccaccacgcgatcaaggtccgccagtgttcgattcatacttctcctttttcgcgtctgcggcgcttatgcgcactattgatgcagacgagggtgatttacgtcaatgcttaccggccatgttaacttatcctgtgggcgaaatacggtgaaagttaacgttacgggagcacagagagtaaaagccgtggatggcgcataatcactaatcgcgctaccatctgtagaccgcgttgaccagccggttaacgtacactcaagcctgaatgcctacgtctgcggataggggattcaggccgtagccttcgcgctgccagggtgcaggaagaaatgactgcatctcccgaactggaaaggtgttctggtgtcacaatttactgatgcattttcgcgcaaattttactatttgcgcctgtcggtcacggatgtctgcaacttccgttgtacctattgcctgccggatggctaccagccaaatggtatccgcaataaaagctttctctcgctggatgaaattcgtcgggtcacccgcgcctttgcggcggcgggcacagaaaaagtgcgcctgaccggtggcgaaccttccctgcgccgcgactttaccgacatcattgcggcggtcagggaaaacgcggcgattcgtcacatcgccgtcaccaccaacggttaccggctggcgcgtgacgttaagcaatggcgcgatgccgggcttaccgcccttaacgtcagcgtagacagccttgacgcacgccagtttcacgccattaccggccaggataaattccatcaggtcatggcgggcattgacgcggcgtttgaggctgggttcagccaggtcaaagtcaatagcgtactgatgcgcgatgtgaacagccataatctgacgacctttcttgactggattcgtacccgccccattcagctgcgttttattgagctgatggaaaccggtgacggcggtgcgctgtttcgcgagcagcatgtgtccggcgaggtgatccgcgataagctgatcgcgcagggctggcagcgccgcatcagcggtcgcagcgatggcccggcccaggtgttttatcaccccgattacgtgggtgaaatcgggctgatcatgccgtattccaaagatttttgcgccagctgtaaccgcctgcgggtttccgcgcagggcaatctgcacctctgcctgtttggtgacggcgggattccgttacgggatctgctcgcgtcagacgatcagcagcaggaactgcaggcgcgtattgccagcagtctgggacagaagaaacagacgcatttcctgttacaggggaataccggtattacacagaatctttcttatattggcggttaattgcaggagcaaatatgggtaaaccagccagcgcgtttcaaccgttacagcttgctacgttaacggtttcagacagccgcgatgccggcaacgatacatccggtgattatctgcgtgaagccgcgatcgaagccggacacagcgttatcgaccacgccatcgtcccagacaatctctaccgtatccgggccattgtgtcacgctggatcgccagtgaagacgtgcaggtggtgatcgttaacggcggaaccggttttaacctgaaaaacagcacacccgacgcgctgcttcccctgttcgatcgggaaatcgaaggctttggcgagctgtttcgcatgatttcctatgaagagattggcggatcgaccttacagtcccgtgcggtcgccggcctggcaaaccagacgttgatttttgccgttcccggctcgacgtcggcctgcaccagtgcctgggagcgcatcatcgccgatcaactggatgcccgtacgcgtccctgcaactttgtcacccatttaaagaaacgttaagcatgtcacaactcacacacattaacgccgccggtgaagcccacatggtggatgtttccgctaaaaatgacaccgtacgcgaagcccaggctgaagtgctggtgctgatgaagccagaaacgttacagatgatcatcgagggcagtcaccacaaaggggatgtgttcgcgacggcgcgcatcgcgggcattcaggcagcaaaacgcacctgggagctgatcccgctttgccatccgctgatgctgagcaaagtggaaatcgcactggtggcggaaccggaatcgaaccgggtgcgcattacgtccctgtgtcggctcagcgggaaaaccggcgtggaaatggaagccctgactgcggcttccgtagcggcactgacaatctatgacatgtgcaaagctgtacaaaaagacatcgtgatcgatcaactgcgtttgctgcataaaagcggcggcaaaagcggcgattttcaggcggttgcccatgattaaggtgctgttttttgcccaggtgcgggaactggtgggaaccgattcgctcaccctggctgcggagtaccccaacgtggctgcgctgcgcgctgcgctggcgcagaagggcgatcgctgggcgctggcgctggacagtgaacgtttactcgccgccgttaaccagacgctgaccgcgatgagtcatcccttgcaggacggggatgaagtggcctttttcccaccggtcaccggaggataaatggaaacgcaaattcgggtgggcccggctgcttttgatatggcccaggagtaccagtggctggcggcatgtaaagaagatggcgccgtggtgacctttaccggcaaagtgcgcaaccataatttgggtgatgatgtcgccgccctgacgctggaacattatcccggcatgacggaaaaggcactcaaggaaatcgtcgatgaggcacgccagcgctggccgctgcagcgcgtttcagtgattcaccgcatcggtgaactcttccccggcgatgaaattgtgtttgtcggcgtcaccggtgcacaccgcggcagtgcatttgccgccgcggagttcattatggattacctgaaaacccgcgcgccgttctggaaacgtgaaaccaccggacagggcgatcgctgggtcgatgcgcgcaacagcgatcgcgaggccgctcagcgctgggattaaggcgttgaaagctgttctgcgggggcaaactgggtcttgccatgtgcgtgttcgcctccgcccttgccacgttgcaactgaatgacgtcaccgtcctgccaggcgttggcaccgggaaccaccgggtgcgcgtcaatatcggcccgttcagcacgaattttgtgactgtcgagagcaaaacggcgatcgcgatcggccagtaagcgcgagtccatttgctcatcggcggtaaagcccatcatcaacgccggaatccccagcggcaactgtttgtcacggtcggtgtgccaggtatgccacgttttaccgtaggtgttgacgatgcgcgtcatcagcgcatgttccgcggcggcaggcaggccgggtgcgaccagcgaaccggatttcacctcgtactgatggctgtgccacagcttcttttcctcgttgggcaaggtccggtacagccgttcgctgatgatatattctacgcccatcaggcgcgcatcgcgcgtgttgccgtcataaatcaccgcctgcataacgtcatcatttaagaccgtgacatagtgatgcgcttccatctgaccgtttttgtcgccgttatagaagtgaaaaccatccagataggcattgatcgcgtcaatcggcggtcgtgattgcagcagggcggcaccgctgtccagcgctttcaggccaggagaggttggggcgccaggcgaacggacctgggcgggcgttgtgttaccgccgcaaccggccagtaacaggctgagtagggtaactgtccagagttttgacataaagcatccctttttcgctaatttcgctaaaagagataaccttagttcagataatcaaacctgccctgcgaagcggggcagtgttaagctaggttttttccccctcagaggacaggtatgtcattcacttcattaccaaaacgtctgacgctgctcgccatactgatcctggcgggctgtagcagtaaaaaaacgccggaagcgcctgcaacgcagcctgaggatgtgaaagcacagattcagcgcctgctgcctgccaatgtcagcaacaaatcaggctgggctgatgatatctatacctcgttccgtacccaggggcttgaggccagcgacagcaacctgtgcgcggttattgccgtcgcggggcaggagtcaggttttgatgccagtgggaatgtacccgggatgtcaaaaattgcctgggatgagattgaccgtcgggcggctaacgtccatgttccggcgtttttagtgcgcaccgcgctgttaattaagtccaccaacggcgaaagctatgccgcgcggctggataaagcgaaaagtgaaaaagatctgagcgatattttcgacgattttattgagatggtgcccatggggcaaacgctgtttggcaacctcaatcctgtgcacaccggcgggccgatgcaggtcagtattgcctttgctgaggcacatgccaaaggctatccgtggccggtagagggatcgatacgacgtgaagtgttcacccgtcatggcggggtttacttcggcacgatgcacctgctgggctatcccgccgattacagcaagccgctttaccgtttcgcggactataacgcgggctggttcgccagccgcaatgccgctttccaggcggcggtgtcccgcgccacaggcatgaaactggcgctggatggcgatctgattcagtatggctccgacaacgcgggatcgacggaactggcggtgcgtaccctggcgaagcgcctcgatatgagcaacagcgaaattcgcgacgatcttgagctgggcgaaaaggctgaattcagcgacagcgacgtgtggaagcaggtctttgcgctggcggataaaatggccggacggcgattgccgcgtgaaatattgccgggaatcaagcttgaaagtcccaaaatcacccgcaatttaaccacggcgtggttcgcacagcgcgtcgacagccggtatcagcagtgcatgtcacgtcgataagcacggcgttgtggcgcagttgaacagagctgtgccacacttaaccaggctcccctgtgaggggaataacccattcgtttaacaagaggtgcatcatggaccgatatccacagaatgattcaatagttcagcctgcatctcgcgggttgcaggcttacatggcacaggtttatggctggatgacctgcggattattacttaccgcgttcgtttcctggtttgccgcccgcacgccagcggtcatggagctggtttttgcaaaccggataacctttttcggcttgatcattgtgcaactggcactggtgttcttcctctccggcatggtgcatcgcctgagcggtgccgtggcgaccgggttgttcatgctttactcggcgctgaccgggttaaccatggccagtatcttcctggtgtatacctattcgtctatcgccagtacgttctttgtgacggcggggatgtttggtgccatgagtttctacggctacaccacgaaacgcgatttgagtcgcctgggcagcctgctgtttatggcgctgattggtatcctgctggcatcactggtgaacttctggctgaaaagcccggcgttaatgtgggcgattacttacatcggcgtggtggtgtttgtgggtctgacggcgtatgacacgcagaagctgaaaaacattggtgagcagattgacgcgcgcgacacggaaaacctgcgtcgctactcgatcatgggcgcgctgacgctctatcttgatttcatcaacctgttcctgatgctgctgcgtattttcggtaaccgccgttaataaaacaggctgctctggtttgccagagcagccgctcctcggttatgacttctgcagtttctgctcgtttttatggcgcatatgtttcgcgcggctctccagtcccagatacagcaccagtgccagcagcaggggcaaaataaaatagagcacccggtaggccagcagggccgcaataatcgtaccgtgagagagatcttcgccgctcaacagcgctaaaaacaccgcttcaagcacgccaatccccgccggaatatgaataatcacccccgcaatgctgctgatcaacagaacgcccagcaccatcggatagccgacatcctgacccagcagcagccagataatggtgcccatcaccatccagttggcacaggaaacggcaaactgaaacagcgccatgcgcaatgaaggcagttgcagcgtctggcctttgaccgtccagcggcgacgtttagaaaaggcacaggaccagagatagaacgccaccagcaccagcaggacaaccccaatcagtcgcaacgtggtttcgccaataaaccagccgctgggtatagaaaccatgccagcgctgaataccacgcccgccagcaggatatagcccagccagttggtggcgatgctgagtgagaaaatgcgcgtaatagtgccgctgtccaggccaaggcgcgaatagagccggtaacgcatcgccacaccgccaacccaggtactgagcgtcaggttaaaggcatagcaaataaacgacaccaacatcacctgacgctttgccagtttatggccgcagtaggcccggccaatcaggtcgtaacagccatagacaaggtaactgacaatgaccagggcggccgcggtcagcaccacatagcggttatagttaacgatgacgtcataaacgtcaccccagttcaccttacgtgcatagatgaccagcagcacaatgacggcaacaaagaacaggccggtaagaatctttttcgccagcttccagcgcggatgcgtatttgccatcaggatttcgctccttcgttattggtttcgacgcggtcttgcgtctccatttcaggctgaacaggcggatcgatctgggccagcttaggggtatgtgcaggtagccatccggcgatagcagggaagtgccgcaggaagtggaacacgaccacgcttttggtcagttgccaccaggtgcgcggcggcagtttgtcctcctgaacacgctgacaatcttctgccagtaaatgctcaagattgtcgcgtaatgtttcattaaagtggcgatcgtgaatgatcaggttggcttcgaggttcagcgacaaacttaagggatcaaggttactggaacccactgtcgcccactgctgatctttcacggccactttaccgtgcaggggccgacggcaatattcatagacttcaacgcccgcatccaccagatagttatagagcagttctgcgcccactttaacgatcggcatatccggttcaccctgcacaattaaacggacccgaaccccgcgctgcgcggcattgcgcatttcccgcagcaaccgatagccggggaaaaagtaagcattagcaatgatcacatcctgtttggcactgcgcagcatgtccaggtagtgctgttcgatatcgtcccggtgctcattgttgtcgcgataaacgaacagcacctgcgcgtcgccgggcagggcatttttcgccgggcgatgtgagcgctgtccccaccagcggcgcgtagtggcttcactgccaatcgcttcttgcaggtagcgggtaatatcggccaccaccgggcctttcacctccacggtgtagtcttgtttcgcttcaggaccgtaatccgtgttgtgctcggcagagaaattgataccaccgacaaacgcgataaccccatcaaccaccacggtttttcgatgcaggcggcggaagacattggtgcgcatgcccatcaccagcggacgcggatcgtaatagataaagcggacgcctgcccgggtgaggctgttcacaaagtcgtctgacaactcggaagacccgtagccatccaccatcatttcaacctttacgccgcgctctgctgccgccagcagttcacggtgcaaggcattgcccacatcatcttcaaacaggataaaggtttccagcagcacgctgcgttcggcgcgctgaatggcgccaaacacccgaggaaaaaacgtatcgccattttccagcaagcgcagtttgttgccttcttgccattcaaaattcatagatggatctccaccgccagcggcgcgtgatcggaaaggtgtgaccagggtttacgcggcagcgcccagggatgactcaccgtggcgttgcggacgtaaatacgatccagtcgcagaagggggaaacgtgccggaaaggtgcgcgccggtcggccatttttgaggctaaacacctctttcagtcccgcccctttttgcaatattttattggcccggccttgccagtcgttgaaatcgccggccaccacaaccggagcatcgggcggcagcgctttgaccatctcgttcagcatcgccatttgggcgcgacggtgggccgctttcaggccgagatggacacagatgacgtgcagcgtgccgtaaggctcgggaagcgcgattttgcagtgcaacatgccacggttttcactcccggcaacagagacatcgcggttctcatagtcggcaataggaaagcgcgacagcacggcgttgccgtggtgtccttccggatagacggcgttgcggccataggcgaaatcgttccacatggtgtcagccagaaactcataatgtgaggtattgggccagttttcatgttgcagtgggtggatatcatgtgttcccatcacctcctgtaacaagacgatatctgccgatgttgcacgtaccgcgtcgcgcaattcaggcaagatgaagcgtcggttaaacggggcaaaacctttgtgggtattgatcgtcaggactttaattgaaaatccttgcttaatttgtggcatactcgcgacgcgctccttttcatcttcgttaacgacaaagtgtagtctttgtcacaaatggagggtgaagaagaggaataattaaggcgttatctgaaatttgctttacattgaggaaaccgtccctggccggattcggttgcatttgagcaactcgccaggtctgcaggagaaaaatatgaaattgtctaatcgctttcaaattattaccggtcaaacctgggcccacatcgctatgcacgtgttggtgattgccgcgctggtatggggctggaaacataaagcactggtcgaagtgtgcagtaccctggtggtgacgtatgcaggggtgtttatcgccatgctgatcacgcagcgtagtgcccgtttacgcaccctcggtgattacctggaagaggcgaccaccacctactattttggcgccgccatgatgatgctgttcctggtctcgcgcatcttccacaacaacctgctgttagccagccttggcatggttatgctgctgggcccggcgctggtttctctgctggtgaaagagcccgcacgacgtattgagaaaaaacgcagctaagttagccgcccaatgaaaagccaccgcaaggtggctttcttgttttaggggttatgtaatcaattgtgagctatctcgcacagagacgttaaagctgttacactccgccgcttatgcatcgtagtttgcacccttttcacgcgtcagcgtcagctggcgtcactatccctctgaaaactacaccgtgaaacacggtcagagtggaccggagtaatactcgtcatgtcttttgactctctcggcctgagtgccgatattttgcgtgcggttgctgagcaaggctacagcgaacccactcctatccagcgccaggctattcctgtggtgctgtccggtcgcgatctgctggcaagcgcgcagaccggcaccggcaaaacggccggttttacgctgcctttattacagaagctgtcggcaaatgcgggcgcggtgcgtggacgccgtcctgtgcgtgccctgatcctgacgccaacccgtgaactggccgcccaggtcggtgaaaacgtggttgaatacagtaagtatttaccgcttcgttcactggtggttttcggtggggtaagcattaacccgcagatgatgaagctgcgcggcggggtcgatattctggtggcaacgccaggccgtttgttggacctggtccatcagaacgcggttgacctttcccaggtcgaagtgctggtactggatgaagccgatcgcatgctcgacatgggctttatccatgacattcgtcgcctgctggcaaaattgcctgccaaacgtcagaacctgctgttctcggcgacgttctcagatgagattaaaaccctggcagaaaaactgctgcataacccagagcaggtggaagtggcgcgccgcaacaccgcctctgagcaggtttctcagcaggtgcattttgttgataagaaacgcaaacgggaattgctgtcgcagctgatcggtgaaggtaactggcagcaggtactggtgtttacccgaaccaagcatggtgctaaccaccttgccgagcagttgggtaaagacggcattaccgcagcggcgattcacggtaataagagtcagggagcacgtacgcgcgcactggccgattttaaatccggttcgattcgcgtactggttgctaccgatattgcggcccgtggcctggatattgaagaactgccacacgtcgtgaactacgagctccccaacgtggctgaagactatgtgcaccgtattggtcgtaccggtcgtgccgcggcaactggcgtcgcgctgtcactggtgtgcgtggatgaacacaagctgctgcgtgatatcgagcgtctgcttaagcgtgagattccgcgtctggccgtgcctggctatgagcccgatccgagcatcaaagctgagcctattgtgaatggccgtcagtcgcagcaaccccgtggtcgtagccagggtggacagggtgcgggtggtgcgcgttcacaaggggataaacgttcccagccgcgtcgtcagggaccggcaacgagccagtctgataagcctgctgctcgcccacgtcgccctgcgcctaagcgtagcggaaacgcctgacaatgcgggttttgctggcaccaatggaaggcgtactggattccctggtacgccagctgttgacggaggtcaacgactacgatctgtgcattacagagtttctgcgtgtcgttgaccagctcctgccggtaaaatccttctatcgtctctgtccagaactgcaccatgccagccggacgccatcgggcacgctggtccgtctgcagttgctcggacagcatcctgactggctggcggaaaatgccgcccgcgcggtcacgctgggttcctggggcgtcgatctcaactgtggttgtccgtcaaagctggtcaacggcagtggcggcggtgccacgttgttaaaagatcccgatttaatctaccgcgcggcgaaagccatgcgcgccgctgtgcctgacgctttgccggtcacggtgaaagtccgtcttggctgggattccagcgcacgcagcatggaaattgccgatgcggtccagcaggccggtgccagcgagctggtggtacatggccgtaccaaagaagatggctaccgcgccgaggcgattaactggcaggccatcggggaaatccgtcagcgcctacgtattccggttatcgccaatggtgagatttgggactggcaaacggcccaggattgcctgcagacgaccggctgtgatgccgtgatgattggtcgtggtgcgctcaacgtgcctaacctgagtcgggtcatcaaatacaatgaagccccgctgccctggccggaggtggttgcgctgttgcaaaagtacacccggctggaaaagcagggcgataccggcatgtaccatgtggcacgtatcaaacagtggttgggttatctgcgcaaagcctacggtgaggccggcgagctgttcggagagattcgcgcgttaaaatcttctcaggagattgccacagcgattgaccgttatgccgaatggcacgggcagacctgtcattaatcgtgcggcgttttgtggcgtcaacaacgggtagcgcagcgtcctgccgcgcagaccattaatacttttcaggcacgatcatattgtccggcacgtcgttacgacggtaatcctcagaccgttcgcgcggtggcagaacgatttcatcatggggagagtcttcataaggcacctgttgcaaaaggtggctgatgcagttcagacgcgcacgctttttatccacgccctgaacgacccaccagggcgcatccgggatattggtgcggctcagcatctcttcttttgcttcggtatagtcttcccagcggcggcgactttccagatccatcgggctgagtttccactgtttgagcggatcgtggatgcggctcataaagcgcaactcctgctcctcgtcagtaatggaaaaccagtatttgacgatttgaataccgctgcgagtcagcattttttcaaactccggcacgctgcgataaaactcctcgacctccacctcattacaaaagcccattacgcgttccacgcccgcccggttgtaccagctcctgtcgaacagcaccatttcgcccgcagcaggtaaatgcgcaatgtaacgctggaaataccattgcgttttttcgcgatcgttaggcgctggcagtgcggcaacccggcaggtacgcgggttcaggcgctgcgtaatgcgtttaatcacgccacctttaccggcagcatcgcggccttcgaacaggataaccaggcggtgaccggtgcgcatcacccagtcctggagcttaaccagttcaccctgcaggcgcagcagttcgcgaaaatagtgacgacgccaggccttttcatccgttccggctggcgtggtatcgccaaaacgcagatcgtcgagttccagctccagttcttcatcgtagctgtcgtagaactcctgcaataaacgctgattaaacgcgtcgcggttgaaactgttatcgtgtgttgccatgacgattcacctggtcagatgtggataaacagcccgtagagcagggccgaaagtaagacggaaaccggcagcgttaatacccaggccacagccagattccgcagcgtggacatttgcaggcctgaacggtttgccgccatggttcctgctacgccggacgagagaacgtgcgtggtggacaccggcaaaccgaatgcgtcggccgcaccgatggtcaccatcgccaccatttcggcgctggcaccctgggcataagtcagatgtgttttaccgatacgctcgcccacggtgaccacaattcgtcgccagccaaccatggtgcccagccccagcgcgatagcaacgaccaccttcacccacatcggaataaagcgcgtggcgctgtccagctcggtcttgacggctttcaggttacgttgcgtctgatccggtagggcgacgttagcggtttgcaaatgcttaatggactccgaagccagatacatttgatttcgggtattggttacggattgcgccggaatattttccatggaaccgtaacggcgaatctgatcgcccacgtcgtgcagtgtcatggccagcgcaggcagaacgttgggattgggtttcccgctgctgacaaacgcggttaacacgtcgcgtggaacaggcgcgggcgtggcggcaggctgaatatgcaacagctgttgtgccgtgacttcggtcagtgcggcaacgcggggtatctggtcggacggcagagaacggttcagggcataggcgatcggcatggtgccgaccagaatcagcatgatcagtcccatgcctttttgtccgtcgttcgacccatgggcaaacgaaacaccggtacaggtcagaatcagcagtccacgaatccagacgggcggcggctcgttgctctgcggagcctgataaagttggcggttacgaataaacagcttcatcgtccacagcagcagggcggcgcagacaaatcccaccaccggcgacagcagaagggcataaccgactttcagggcctgctcccagtcaacgccactcaagccactgcgaccgtgcagcatagcattcgcgacgccgacaccgataatggagccaattaaggtgtgcgaggaggaggagggcaggccgagataccaggtccccaggttccagataatcgccgagaacagcagggcataaatcatggcaaagccgttaccgctgctggcctgcaatatcagttcgacgggcagcaatgaaataatgccaaaggcgaccacgccgctggagagcatcacgccaagaaaattacacagccctgaccagaccacggcaacaccgggcgtcagagagtgggtatagatgaccgtggcgaccgcattggcggtatcgtgaaagccgttcacaaactcaaagcccagcgcaatcagcaacgccaggcctagcagaaagaacggcaaataactggtgacgggcgtattggttttttcaacatcgtggaacaggttaaacccggcaaaagccagaccggcgatcagcagaacaatgaagatcgtttttgtgaagcggctacctttgccattgaaatcagggcgtccatgagtcgaacctgaagagggtaaactgttttcgctcatgcaaaacctcttagcggatgcagatgcggatttacatctggttaacgctgtttgatacccgctttttgtgacaaaaaaatgatctacgccgtgcgaggtcattttgctgtaacaaaactgcagcaggctgggagtctttattgatgatgctgacaggattgccatggcgacagacgttgttcttcccccacaaaaacgtgattttgatgatgatgtggccggactcatccatggttatctcttttctcccgacgctctccctgtccgcctgaatgcccgtgaagcggtcaaactcggggaggcgctgcctgacgacggctttctctggctgcatatcaacctgaatcatgcccgcgcgcagaactgggtgcagagtcacttccaggtggatgatgacttcttcgacgaaattcactctgcctcaccgcgtacccgactggcggagcaaagtagcgcgttgctggcggtgctaaacgatgtcacgctcaatcaggaaaaccgcagtacgcaaaatgcgaccctgtggatctggtgtcggcgcaatctggtggtgagcgcccgttatcgcccgtcggtgatgattgaaaagatgcagcaggggttaacccgacacagctttcccagtgcagaagccttgctgctttatcttcttggcgagcaggagttacagctggaacaggtggtgcggcgtatcagtcaggtggtcgacagcatagaagagcgcttattaagtacggcgattaaagctaaccgcagtgagctggggcattaccgacgtatgcttttgcggattcagcgtcttctggcaccggaaccggcggcactgtttcgcttgctcaaccggcctccggcctggctaaaccgcgacacgcttcgcgagctgcgtgcgtttacggaagagttcagcgtggtgcttaacgatcttgccagcctgatggagcgcatccggcttctgcaggaagagattgcggctcgcctgatggagcagagtaaccggacgctttacctgttaaccgtcattacggtgctggcgctgccgattaatatcgtggcggggttttttggtatgaacgtgggcgggattccgctggcctcgaatccgcacggttttttactgctggtgctgatcgtattcgtttttaccttgctggcaggctggctgacctttcgacgaccctcggcgtagcggcctgagcgcgtaagatcgggccggggtgacgtcataaaaaaagccagcgcggattatcctgcgctggctttttaacaacctgaagacggacagccttacaggctaccgttacccgctggagccggttgcgacggttgtacgggctgttgctgggcaggctgcgactgttgaggtgcaggttcctgctgtacagcggccggattagcaggctgtgacgtcagcggcgtcattggcccttccttcggctcggcatcttcaccttcggtcatctgaacgggcgcgggcacgacgttgttttcgggtgcgttaacctgaacgggcataccagagcggttctgaatggctttatccacctgagactggttgatgctgccatcgaccagcactttgccaacggcctgggtcagcgtaatcggcaccagctcacgagagttaaactgctcttccgtggtagacagtggattatggacttccatccaacgtgaaccgtctggctcaaccgaggcttttaccggctggttgataaactgtacgcgcgtgccaaccggcacgtggtcaaacaaccacttgatatcgtcggcacgtaaacgcacgcagccgtggctcacacgcaggccaataccgaagttggcgttggtaccgtgaatggcgtaaagacgaccgatatagagcgcatacagccccattgggttatccgggccagccgggaagacagcaggcaggttctcaccccgagacgcgtactcagcatgcatcgctttcgttggcgtccaggttggaccatcttttttacgctgaacggtcgttgtccagttcagcggcgtgtctttacccagttcaccgataccgataggcaacaccacaaccgttttgctgcctttcggatagtagtaaagccgcatttcagcactgttaatcacaatgccttcacgcggtgcgtcaggtaacagtaactgctgtgggatgatcagtttgctgccaggtttaggcagataaacgtcaacgcccggattggcttccagcatattgctgaggcccatttgaaactgtgctgcaaaagcttccagaggcaatttactgtcctcaggaatggtaatttcaacgttttgcccggtcagacggctgttagccggcggtaaagggtaaacaacagcaagggctgactgactgaatgccgccaaagccaatgcaagtgaagcgaacgcgcgaatgctttttttcatattttacaagtctttatcgccatgtttcaggcttgtcaatgtatcgaacccatgctggtcactatgacctgctgcgcattatatgttcattaaactgatgttgtgaatcaggattttaaccactttgaaatactttacctgactcacctgcgttatccgcctttgttctttaccattttgggcggaaacaggcccttatggttgccataaggtaatgtccccgttcagcttacggttgagaaaaaacgcggcactgatcaacgcaagatgcgtcagcgcctggggcgtattgcctaatgcctggccatgactgtcaaactcttcagcatataaacccagcggattagcgtagctcagtaatttctcgaactcaaaatgtgcctcgcgaatgcgtccggcacgcgccagacattccacataccagaacgagcaggcaccgaaagagccctctgcgcccgtcagcccatctgctggcgtttcatggatgttataacggcgtaccatgccatcgctcaccaggttcacctggatggcatccagcgttgcgatccagtcgggatcggtcgcaccgacaaagcggactaacggcatcaacagcattgaggcatcaaggtgttcaccgtgacgggtagaaacaaaatgcccgcgttcgctgttccagaaatttttccagatatcatcacgaatctcgcgacgggttttgtcccagcgctcatagggcatcggcagtgaacgtttcatcgcaaggcgcaggccacgatccagggcaacccagcacatcaagcgggaatgaaggaagtgctcgggctcaccgcgcatttcccagatccccgcatccggctgatgccagttatcgcacagccagtccagcatctctgacacatggttccagccacgttgagaaatggcttcgccgtatttatttgaaagatagatggcatccatcagttcgccataaatatctaactgtttttgccgccaggcaccgttaccaatgcgcaccggactggagttggcatagccggacaggttaagcagcgacatctcctgaagatccgtactgctgtccaggcggtacatcacctgcagccgcatttcatcatggtggctgttctctacacagcgaccgacccattccgtaaagtgcctggcttcgtccacgtaacccagccgcatcaaggcgtacatgctgaatgaggcatcgcgtatccaggaggcacggtaatcccagttgcgctcgccgcccagttcctcgggcaggccaaaggtggcagccgcagcgatggagccgtgttgccaggaggtcaacagtttaagtaccagtgcagagcgttgtaccatctcctgccagcgaccgtgataggtgctgcggctgctccattcacgccagtagctcagcgtttcttcaaagcagttagcggtggccagcttttcgatgtgggcatcgtgtacgctgccaaattcgaattcggcatgttcaccggctttaagctcaaagctggcggtggcgtgattgccttccagcgtcatcaccaccgtcgccgccaggcgcagcgacggctgatcggtggcgtgaaaatcaatacagccacgttgtacctcagcgcgcgtgtctgcacgggcgtaatcatgacgcggggaacagaccatgttaaagcgcgcccggccgcgtaccatttttacccgacggatgatacgcggcagcttatcctcgcgatcgcagatcggcatgtaatcggtgatttcggccacgccttcttcagacagccagcgggtctgtaaaatgttggtatcaggaagataaatttgctgacgacgggcgttttgccagtcgggtgccagggaaaacaggcctgcctcatcgctgtccagtaaggctgaaaacactgacgggctgtccagttccggccagcagaggtagtcaatagtgccatcgtttgcgaccagcgcgcaggtgcgtaaatcgcctattacgccatgatcgtcaatcttacgtttaaccttactcatcggtttctccctgtcagtgtcagccttaactatagccgggcgcctgcataccgcttcgttctggcacagatcgttaacctgcccgctgctccgcccgctaagggcacaattttcattgcggtatatacttttcatacacttccagaggagaccgtcatgactacaccacaacgaaaagtggcaatcgttaccgcgtcggattcaggcattggcagtcgttgtgctgaaatgttagcagagcagggattcgatattggcatcacctggcggtcggacgaagaaggcgcactgcgaacggcaaaacgggtggaagatagtgggcaacgcgccgagatgatccagctcgacctggccgatccacccgccggaggcaaggtgctgcagcagttgatcgataagctgggccgcatcgacgttctggtcaacaatgccggagcaaatttcaaagccgactttatggacgtgacctgggaagactggcgtaagacctttagcgtggatgtggatggcgtttttatctgcgggcaggtggcggcacgcaacatgattaagcaggggcagggcggacgcatcattaatatcacctccgtgcacgaacatacgccgctgccgggttccgtcgcttacaccgcagcaaaacatgcggcaggcggattaaccaagtcgatggcgttgagtttgctgccgcacaatattctggtgaatgcggtggcaccgggcgcgattgccacgccgatgaataaaatgaccgatgccgatgctcataacgtcaaaatgcctgagattcctgcgggccacccaggtgatacccatgaaattgccagtatggtagcctggcttagctccgaatgggccacctataccaccggtcagtcctttattattgacggtggctttatgctggcgaacccgcagttcaagggttactgatcgtcagctcgacggttattccagtggcgaatcgcccagcgcagtacgaaggcaaacaccacggcggcagccagccataaaaggtgtttaaagtgctgatcgagcttgtgcagccagggggcgataatgccgcctgcaaaatagccgagcgtgacaaacagcagtgaccagatagccgccccgatgatgttgagcaccagaaacttcagcggattaaggcggcttgcaccaataataatcgggccaatcaggcgaaagccgtacataaagcgcgcgccaatcacgaacaggctggggcggcgcttgatcaaccggttggctttaacaattttgtcctgatgctttttaaagcgccgtaaaatacgggtaccaaagcgtctgccaacccagtacagcagctgatcgcccataatgccgcccgccattgccgccagcaccacgccggaataatgcagtaacccctcatgagcggccacgccgcccagcaataagaatgtttctccttcggcaatacagccgataaacagtgccagatagccatactgcgtaattaatccgttgatatccaaatgcaagatgcactccctgtgtgaagacattttctttcagtttatacctgatttgttacgtcatccgtttacgcgttaataagcgatcttttttgccgtttttttgcacaaagcccacagaaattgccttgccgtttatactgtaagcaatgctgcccttacgtggttcctgcatcagaacggggtagcccaactgcatcagaggagtaagcgtatgaaccatgtctggggtttgttagcgcatcctaatcaggaaatgcgcactatcaagcaagagaacgaaacggtttcgcaccattacactcaccacgttctgttgatggcggccattccggtcatctgcgccatgatcggaaccacgcagtcaggctggaacctgggtgaggggcagtatgtacagctgaatatgctgacagcattgggcttaggtattctgttttatctgttgattttgggcggcgtggcggtgatggggcgggttatccactggatggcgcgtgactatcctcagcgtcccggcgtccagcgctgtaccgtgtttgcgggctacgtggcgacaccgctgtttttaagcggcctggtggcgctctatccactggtatggctgtgtgtatttgcgggcgcgctggcgttgctgtataccggttatctcttgtacgtgggcattccgctgtttctgaatatcgaccgggatgagagcctgcggttttccagttccacgctggccatcggcgtactggtgtttgaagttttactggccttgacggtgattctgtggggctacggcccgaacctgttttagcaccctgttgccgcttcaccagcggcaacatctttttaacgctcagaaacaatctcaccaggaaaagttcacggcttcagcgtatgatgctgcggccagcccgcgctctgcctgctcagtcgtcggcggcctgtgttttcacagcgcacaatcttaaccgggtcttttttccacgatgcctgcaaaaattcgcttttcactgttaacgctggcgctgctcgtttccgggcaggttttctcacttccagcacaggcgaccaccacgctgtcgcaaatggcccccattgctcagccgcaaatcgcctcaggcagtgccctgatcgtcgatctgacgagtggcaaaaccttattctccagtcatcccgaccgggtgcgacctattgcctcgatcacgaaactgatgacggcgatggtggtgctggatgcgcatcagccaatgaacgagatggtcacggttgatatcagtcagacgccggagatgcgcggggtgttttcacgcgtgaagctgaacagccagatcagccgccggagcatgcttatgctggcgctgatgtcatcagaaaaccgtgcggcggccagcctggcccatgcttatcccggcggatacaatgcctttattaaggcgatgaatgccaaggcgcgcgcgctcgggatgaaccatacgcactacgtggaacccacgggtctgtcgatccagaacgtttccagcgcagaggatttggtgaagctgttaaaagccacgcgcgagtatcctctgatgggcgaactgagtaccaccaaagaagaaaccgccgtctttacgcaccccagctatgcgttgccgttccgtaacaccaatcatctggtttataaaaatggctggcacattcagctgaccaaaacgggctacaccgatgaagcgggacactgtctggtcatgcgcaccatgattaaaaaccggccggtcgcgctggtggtactggacgcatttggtaaatatactcattttgccgatgctaatcgtctgcgtgactggctggaaacgggcaaagctgcgccggttccggctgctgcgctggcctacaaaaaacagaaagcgggtgaggttgccagcaacgccgccagcggttctactgaagaataaaacctcgccgggtcgttgctggcggcccggtcgatattgatcggtattcctatagtttcatggcaggcgaccacctaaactacccgcaaatggcgagggtgattcgcctgattactgtgccggaatctcattcatatgcttacgttacgatcgtttattgttctgatatttttagcgtcgttcacccttgcgcctgcgttaagcgttgccgcggatgatccggctcaggcgacccccgcgacgcagcagcccgatgacaagcccaaggtcaacgcgtcagtcgatctgcccaaaatgcagaaaatcctcgacaaaattaagagccaggtgtccgttgaaagtgacgagaacaagctcagccgacttaatgaaatggcgctggagctgtcaggcaataccgatacgcttgctcaggctttgcagcccgatcgtcagcagctcgaagctcagctggcggtgcttggtccggcacccaagccggagagtggcgtaaaagagacggcagacgtcacgcgcaaacgcagcgcgctggaaagtcagaaaagtaagctcgacgatcagattaagcaggcggaaggcattaaaaacagtgccttgatgctgtcatcgcaaatcgtcaacctgcgtcgcgatcagctaaaaaacaaactggcacttaactccggcagtatttttgggccgcgtttctggtcgccggtatttagcagccaggatcttgacgatgaaaaaattggcgatttcttaagtgagctcaagaataccgcctcgttgtcctgggaatcgggctggcgtcttggcacgattggctggttgctggccgccgtgctggtgatgacgctgggacgccgctatggtgaagagtttttagcctgggtcagcatcaacaaattgccggaaggacgcctgcgccgtagctttttagcgaccgccgtggccctgaccagcctggcggcggtggtactgacctttgcgtttgtgtcccaggcctttacccgccgtgatgaagtgtccagcgacgtgcaggattttatttaccgcctggtcgaattaagcgtttatagcggtttgattgccgggctggggcgtgccttcctgtccacgcgtcgcccaagctggcgtttacccaccatttccaatgaggtggcgctggccctgaaacctttcccgccgatcaccgcactgttggtgtttattttccagacggtggagtcctttaactacaccgccggcaccagcctgaataccagtatttttgccaatggcctgaccgccttgctcatcggcagcacggcgctggcaatcagcatgcgcaccaagcgcgtacgtcggcgtctggcgcaggaaggaacgccgccggaagcgcgctctacgctggtcgggctgattcagatggccctgacgctgacctccctgacgattctggggtcgctggtgattggttacgtcacgctggcgcggtttttaagctacgagctggtgtggtgtggcattttgtttggttcgttttacatactcagtcacctgattaacgacggctgtgaaagcctgttctcagtcaataacaccacgggcaagcgcattcagggctcactgaatattgatgagcgccacctgcagcaggttgccatcattcttgcggcgatcggcaaaaccttcctgatcttgttcgtggccctggcgttgctgaacggcacctttgcctcctcaaccccgattgaactgctgcaaaaggcgattgagttttggggcggtaagggccttgagtcgctgaatattgtcccggcgcacctggttaacgcgctgctgtgcctgatcgtcggcatttacatcctgcgctcggtacgtcgctggcttgataacgacttcctgccaaagaccacgatggacagcggcatgcgcatgtcattggtgacgctgttcagcaacgtaggctatgtcctgattattttgctgacgctgtcaatcatggggctacagtggaataaactggcctggatcgtcagtgccctgtcggtaggtattggtttcggtctacaggaaatcgttaaaaactttatttccggtctgattttgctgaccgaacgtccggtcaaagtcggggatttggtgacgatcagcggggttgagggggatattcgccgcatcaacgtgcgtgccaccgaaattcagttaggggataaatcgacggtgatcgtacctaactcacagttcatctctcagaacgtgcgtaacgccaccatgggcaatgctcagggcgtagtgaccattacgttaacgttcccgctggatattgatccggtgcgggtacgggagatcctgctgaaggtatatgaggaaaacgagcgcatcctggagaacccggaaccctcggtgtctttcaaagatcttacgtcccagggcattgtgctgagcgtcaccggcaacgtcgccagtcagcgccagatcgccggggcaaagagcgatctgctgttcgatattctgacccgcttacgcaaagagggcattgtcctgtctacgccgcaaaccatgattattgagcgccgccagctggttgctgctgacgcggcttctgacctgacgtcagacgagcagcctcgctaaataaacgggcggccgtttttgccagccgcccgtatttctctgtgtcgatatgctttttgcgcaatcagggctgctttaccgcccagcctttcagtttactggttttaccaattcccggattaaagctgtttgtcggatcgagcttgcgataaaacgaggccagctgcggctgggcttcataaagatgcccgacgttatgctctgccggatattccgcgccgcgagtatgcaaaatggccaacatcttttcttttaacgcatgcacgtcaacgccttttttcacaatgtaatcctgatggaagacatgacagaagaagtgcccgtaatagaggcgatggcttaatgactgggtaatctcatcaggcaggttttcaaaccacgctttatcgttacgacgcagagcaatatccagcgccagaatatcttccacctcatcagcatgaaccgcgtgataacgcaccgccgcgcctgctgcggcaaaccgatgcaggaaggcgtgcgccccttctttgccctcacattcgaaaaactcgccaccgccctcgcgaaaaaactcacgcaggtagtcgcgtgcttccgcaatgccgtcgcccgacattttcagcatcaaatgatgttggtatttatcacggtactgtttcatgcgcctgggaagatggacaggaaagagacggctgaggcgttgcagcagtcgatcgcttaaatggggtttgataaacgatactttacttaaccagccatcaacccggcctttgagcgtgaaaaacagcggcatcttgtcggtgccgagcttatcaatcatcaggaaggtgtctttgccatacacttcggcgatgtcgtaaatatcccgatgcatatattcagcggcgacgggcaggtttttaaaattcgccagcatatgacagcgcagatcgcccagtacgctggcatcattggtgccgatataaaacacctgctgctgaggttcgcgcgcaaaagtatccaggcgcaccgcaaacaccgccagcttacctgcgcagccggacgcttcaaacaggcggcgggcatcggcgttaaagcgggcgggcgtatcggcatggacgtcgcgcacgcgttcggcatagtcgtggtcggacgcatggcggccgtcatgcaaaacgtcgttcggttgccagcggtcatcgtccagccgtcccagaatttcttccggcgaggtacccagatcgataccgagatggttgactaacttcagccgtccctgggcatcaatttgggcaaacaacgccatctcactgtacgccgggccgcgcttgatcagcgaaccgccggagttgttgcagatgccgcccagcaccgacgcgccaatgcaggatgatccaatcacggaatgcggttcacggcccagcggcgcaagtattttttccagctgatacaacgtactgccgggaaaagccagcacctgtttgcccttatcgatcagctgtagcttatccagcctcagagtactgataatcaccagcgggcggtcgtagtcgttcccctgcggcgtcgatccttcagtcaggccggtattggctgcctgcatcagaataatggcatccgcattaaccagcgtttgcagtacgcgccacagttccagcagcgtcgcaggaaagaccacggccagagcatctccgtcaccagaacggaagcctttgcgatagcgggcggtgtgagcagcctcggtaagtaggttaccagagccgaccaggcggcggagatcggcgatcagggcagaaggtgtcatcatgggcaattcccttgtcttatgcatgcgtcattactgtagcacgtgagttgcattgggcgcagtgtgatagcggcaggctacatgctatgctctgaagatggcatcctgcatttagtcgatattgcgcagttacttaagagaacccaacctgatgaaatggatttgctctgttagcctcgctgtttcccttgctatgcaacctgcatttgccggggagcccaccgctcaccatcccatgactgaacaggcgcgtgatgcctacgtgaacaacctgctgaaaaaaatgaccctggacgagaaaatcggccagctacggttaatcagcgtggggccggatacgccaaaagaagccgtgcgtgagatgatccataaaggtcaggttggcgccatttttaataccgtaacgcgtcaggatattcgcgcgatgcaggatcaggtcatgcagctgagtcgcctgaaaattcccttgttttttgcttatgacgtggtacacgggcagcgaacgattttccctatcccgctggcactggcatcaagctgggatctcgacgccgtgcacgatgtgggccgtatctccgcctatgaagcggcggacgatgggttaaacatgacctgggcaccgatggttgacgtcagccgggaaccacgctggggccgggtttcagaaggcttcggtgaggatacttatttaacctctgccatgggacgcaccatggtgcaggcgatgcagggcaaaagccccgcggaccgctacaacattatgaccagcgtgaaacactttgcgctctacggcgcggtggaaggcggacgggattacaacaccgtggatatgagcccgcagcgcatgttccaggattacctgccgccgtataaagcctcgctggatgccggcagcggcggcgtgatggtcgcgctgaattcaattaatggcgtgcccgccacggccgacagctggctgctaaaagatctgctgcgtcatgaatggaaattcaaagggatcaccatcagcgaccacggtgcaatcaaagagttgatcaagcatggtgtggccagcgatccgcaggacgcggtacgtatcgccattaaatctggcgtcgatatgagtatgagcgatgaatactacagccagtatttgcccgacttagtgaagcgtggcgtcgtcagcaaagccgaaatcgatgatgcggcacggcacgtattaaacgtgaaatacgatatgggattatttaacgatccctacagtcaccttggaccgaaagagagcgatccgcaggacactaacgcggaaagccgtttacaccgtgctgaagcccgtgacgtggcgcgcaaaagtatggtgctgctgaaaaaccgccttgataccttaccgctgaagaaatctggcaccattgccttaatcggaccgcttgccgacagccagcgtgacgtgatgggaagctggtcggcggcgggcgtcgccaaacagtcagtttcgctgctgcagggcatgcaaaacgcgacggaaggcaaagccacgttgctgtatgccaaaggtgccaatgtgtcagataacaaaggcattcaggacttcctcaacatgtatgaaccggccgtagccgtcgatccgcgttcgccgcaggccatgattgatgaggccgtcgaaaaggcgaagcaggccgatgtgatcgtggcggcggtaggggaagcgcagggcatggcgcacgaggcgtccagccgcagtaatctgatgatcccaccttcgcaacagaagctgttagccgcattgaaagccacaggcaagccgctggtgattgtgctgatgaatggtcgcccattgacgctggttgatgaagacagaatggccgatgccatgctggaaacctggttcagcggcacggaagggggcaatgctatcgcggatgtgctgtttggcgattacaacccatcgggtaaactgccgatgtccttcccccgttcagtgggacagattccgatctattacaaccatttaccaaccggtcgtccttacaattttgccaagccgaacaagtacacatcacactattatgatgcggaaaacggcccgctttatccgtttggttatggtctgagctacaccatgttcaccgtatcgccggtcacgctgtcatcagaaacgatggcgcacaacggcagcattgatgccagcgtcaccgtaactaacagcggaaaagtggatggtgcaaccgtagttcagctttacctgaacgatccggttgccagcatcagccgtccggtaaaagagttgcacggctttaaacgcattatgctgaaagcgggtgaatcccagcaggtcaccttcaagattgacgttgatgcgctcaagttctggaatcagcagatgaagcaggttgccgagccgggcaaattcaacgtgatgattggtctggactctgtccgtacgcaaaacacccagtttacctaccagtaatcctcagcacggccagcctccctggccttgcaggtgtaagaaccgtttccccttcggggagcggttcttacacctctgcttctcatcctgcctgaacacatccactttgagagttttacccttgcctgtcatagcgacagacgtgatcctgctctaacctcggggaaaatggattcctcaagtattgtcgaggcgctatgacgtatcaaccactgattgctgaagtccacaatcagcagcgcaccctgacggccattgtcgaacaggatgcgcgtactgcttatttctatatctggcccaccgatctgtttcgtagccagtttgcggtgcgtggctgctggttacgtaacctgctacctgcccctgtcgaggaagatcatcaggccatggagcagggcattgcccctctgctgagtgcggaatactgccgtaatctggacgctgaaccgccactggatgcggcgggcctgcaaatactctgggaaccgggcgatgcgggtgcggcactgtggtactacgggcaactgctggcggtgatcccaggctggagcctgtatcaggataaacaggtcagcttttcagcgggctgtatcaaaaagaaccgccttaccgcaccgctcgggtctgcctccaccaatcattactatgcgcttgccgaacagcagcgccagttctggcgtgaatggcacgacggaagtgaatgggacaaggtgcaacaggatttactgggctgctatcaggcgcagtttggtgagtcggtaaaatactatgctatcgatcagggtaactggccgcccatggccctgtctcagcactatcaccagggaatctggtatttcctgacgctgggtatgagcattcgtcccatgccgcaggtcgattttctgtttgatgagctggcaccacagtatcgccgcgcagagctggcgatggcggtcgatggcgaggtgatgacagaaagcaatgcggtacagatggccagtgcactggcggaatttgtgcatctgccctgggcgcgactgacctggctgggtgagggacatacgctggcgtccgaggtggcaccggtggggtttgaaagttacctgttagcgaacgaactggccccggaaagtgcccagttttcgttgccgcggcgcgagggtgaccggccaacgctgctgtgggccacgccagtcaccgaagcggaacgccagtttgcccagagcgaagcccagggcgggcagcacctgcgtgagcggctctccgccagcgggaatacgcatatattccgcccgcgcgagcaggtcgtgaagacagaataatcaccgcagacagggcggtgataccgcctgggttaaaaaaaagttactgacctggcgtaattaaatttctttattgttaaatgacttgttaaatttgtgatctggtctactcaagttcccctttgccgtgccgttaaccccgatcaggcaatagcgccacgaaaggtccaggggaacaatgatgttaaagaccacgcaatcccgcttcacagcaacactcatcggcttctttgttgcgctagtgttgatcactgtttgggtgatcaaccagtttgtcgcaccgcaactggtcgacaatgaaagccgcctgattcgctatcaggtggattccctggcaacgggcattgttgagcaaatgaaccgtgtgcaggcacagcaacgtgccatcaccgaggccgcgtcggtgatcgacagcgccgccatcgacaccttattaccagcattggtcaaccagtatcaggacagtaacgtcttcggcggcgggatctggcctttacccaatcgtcgggaggcgggtaaagagaaagacagcagcttttttgcacgcgataccagcaacaagctgcaggttaatacctactggaactctgatgcagccgacaaatactgggagcagccctggtataaagacggtatggcggcaccaaaagggcagtgcgcctgggcaaaagcctatcaggacgccgccagcccacagccgcgtaccaactgcgccatggcaatctaccgcgacggctccgtctggggcgtttcaaccatcgacgttacgctgggtttcttcaaccaactggctaaaaaaatgggcgaggcgattcatggagacgtactgatcgttgaggccgacggcaaagtcgtgggaaatgcggcgctggttaacggcacgccaaaactcgaaaacctgagcgacctgcaaaaccccatggctgcaccgctcaaagcgctgcttgccagtgcaggcacgcagtcaaccgaatccacttacagcggcaatgacggcgagcaaacgctgtttctgcaggccattccgggcagcccgtggtatctggccagtagcgtatcgtccagcctgctgaaagcccagtctcacaatatgctgatgcgcctgggtctggtgcagatcccactggccattattctgttgctggtgctgttgggttttatgcgcgcaatgatgaagcgtttgagcatgctcaaccaaaatatcgaagccttgtcgaccggcggtgccgatttaacccagcgtctgccagccagtaacagcccggagtttaatgcggtagcgcagagctttaaccactttatcagttacctacaggggttaatgcagcaggtgggcagcagtgcgctggccatatccgcagcgtcgcgtgaaattgccagcggcaacactaacctttcgtcacgaacggaagatcaggccagttcgattgttgaaacggcggcctcaatggagcagctgaccggcaccgtccgccagaacgccgacaatgctacccatgctaaccagctggccggtgaggcttcgaaggttgcggcgcgcggaacggaggttgtccgtcaggtggtaacgaccatgggcgagattcaccactcttcgcgtaaggtggtcgatatcatcagcgtcatcgacagcatcgccttccagaccaatatcctggccctgaacgccgctgttgaagcggcacgtgctggcgaacaaggccggggttttgccgtggtcgcatcggaagtgcgcaacctggcgcagcgctcagccaactcagcccgcgaaattaaaaaactgattgaagagtcagtcgctaatatcgatgcaggcagtcaactggttgaacaggcaggccagaccatggacgaactggtgcagggcgtaagcagcgtgacgacgctgatgagcgagatcatggccgccagccgtgagcagagcatgggcatcgagcaggttaacgtcgcgatcacacagcttgacgggacgactcagcagaacgccgtgttagtggaagaggtgtcttctgccgctcaggcgatggaagcgcagagtcttcaactggaacaggtcgtacagagtttcaaactgtaatcgacagtcaggccagcctcggctggcctgacgttttctgccgtcagggccgtcctctgacagatttgtgcataaacagcacaattttatcccctcaacccctccgatcttgtgccagaataatgaggaataaactcaaggaatcctcatgtctgctattgaagttatcctcgtcgaccatcttgatcgtcccaccggcaaaatggaaaagctggaagtgcatgaaaaaggattactgcatcgcgcggtaacggtgtacgttttcaacgcccggcaagagctactgcttcagcgtcgcgccagtgataaatatcactgcggcggattgtggagtaatacctgctgtggacatccttatcctcatgaatccaccaaagatgcggccgaacgtcgcctgcgtgaagaaatggggatgacgctgtcgctttcccccatctttgagctgagctataacctgccgctcagtaacgggctgacagagcatgagtacggtcatgtgtttttcgcggtcagcgacgagctgccacagcttaatccgcaagaggcggacgcatttgattatcgctcgatgcaggacattacacagcaaatgcagcagcagccgcagcagtttacgccctggttcctccatacgtttccccgtattcctgcctatctcgaccgtttcaacttcccggcctaacctgcgcaccctgaccagtgcggtcagggtttagcggtatctgatttcaggacaaaacaggtcgcgcaatgcgattgccaggctacgcttttattgcagcaaataaaaacggtgggcgcgcctgttacggtattcacacggccaaccgcaactccaggtgaatgatttaataaggaaagtaacatggcaaacatgcgcggtttggtcggcatcagcgttttactgcttagtctggggatggcgcacgctgccgatccggtacgggtgggctccaagattgatacggaaggttccctgctgggcaatgtcattctgctggtgctggagaagcacggcgtcaaaactgtcaataaaatccagctcggtgccactcaggtggtgcggggggcaattaccgcaggagagctggatatctatccggaatacaccggcaacggcgccttcttttttaacgacgaaaaagacagtgcctggaaaaatgcccgggaaggctatgaaaaagtcaaaaaactggatgccgagaaaaaccatctggtgtggttgacgcccgcaccggctaacaacacctggaccatcgcggtgcgcaatgatgtagccgagaaaaaccagcttaactccctggacgatctcagcgcctatttaaaaaaaggcggcacctttaagctggcggcttcagcggaatttatcgaacgcggcgatgcactgcccgcattcgaaaaagcctatggctttacgcttaagcaggatcagttgctgtcgctggcgggaggcgataccgccgtcactattggcgccgccgcgcagcaaacctccggcgtcaacgccgccatggcttacggtaccgatggcccggttgccgcgctgggtctgaaaaccctgagcgatcctaaaggcgttcagcccatttatgctcccacaccggtcgtgcgtgaagcggtcctcaaggcttacccccaaatggacgcgtggctaaagcccgttttcagcgcgctggatgaaaaaacattgcagcagttgaacgccaaaatcgcagtcgagggccaggatgccaacagcgtggcgaaagcgtggttagttcagaacaagctgctgtagccgatgttgctatcgcgggaggcgctaaaccggtcaaggcgacagccggtggccctggtgctggttctgttactgagcctgatgctgagctgcctgccgtttgtcagttttgccgccaatcgtctggtggcagggcagccgctgatgttctggcaaacggcgcatggcatggtgattctgcccctgctggctttgctgtggttgctggtgtgggccagaccaacgcgtgtccgttttgcgctgcagttaatgagcgcagccctgctgctggccgcgatgatctggctcagcggcgatcaggccaggatactggccgaacagggcagccggttagcgcgcacccgttttgcaagcggcatgtggtgcgccagtgccgtcacgttgttgctgatcacggacaccgcacgggcgttaacccgtcataaagtgtggcagctgttactgaatctcctggtatggcttcttcccctctggctgctgttcagcggccagctggcccatctttccttactgaaagagtatgccaatcgccaggcggtgtttgatgcggccttactgcgtcatctgacgctattagccgcgaccgtgctgcctgctttgctgatcgccttcccgctggggagtgcactttaccgctatcctggctggcaaagcagcgtattcggcgtgctgaatgtggttcagacggtgccctccgtggcgctgtttggtttattaatcgccccgctggcggggctggcaaaacgctttccatggacaggcacgtggggaatcagcggcattggcatggcgcccgcgctgattgcgctggtgctgtatgcgctgttgccgctggtacgcagcgtagtcaccggactgcaacaggtgccgccggaggtgcgcgaaagtgcgcgcggcatggggctgactggcagacaacagtttttcgcggtggatgtgccgctggccctgccggtatggctggcaggtgtgcgagtggtggtggtgcagacgctgggcatggcggtggtggcagcccttatcggtgccggcggattcggcgcgattatcttccaggggctgctgagcaacgcgctggatttagtgctgctgggcgtgataccggttatcgcgatggcggtgacgctggatgcgttatttcgactgttgatttccctgctggagagaaaagatgattcagtttgataacgtcaccacgttttttgccggtaaagccgcggtgaaaaacctgtcgctgaccgtcgaacagggcacctttagcgtgctgctgggcacctcaggctccggtaagtcgaccacactgaaaatgattaaccgcctggtggagtatgaccagggagacatccgttttgcgggccagtcgattcgccaactggatgcgcaggcattgcgccgtcgtatgggctatgccattcagtcgattggtctgtttccacactggacgattgaaaagaatatagccaccgtgcccgctttgctgggctggtcaaaagcgcggcggcgtgaacgcattgccgagctgatcgcactactgaatttagatcctgccttactcagccgctatccgcatcagctttcaggtggacagcagcagcgcgttggtgtcgcgcgggcgctggcggccgatccggaggtgctactgatggatgagccttttggcgcactggacccggtgacgcgcagtgccctgcaacaggagatgctgcgcattcaccatctctcagggtgcactatcgtgctggtcacgcacgatatcgatgaggccctgatcctggccgataacatcgtactgatgcacgatggtgagattgtacagcagggcaaaccgatagaactgctgacccagccaggcaatgactttgtgcgtgattttctggggcgcagtgaaatggggctgcggcggctggcgcttgggcaagtgggaagtgcggtgcgccgtggggaatggctggaggccgagccggtcaccgctgaactgacgctacgtgaggcgctatcgcaatttatcagccgcggcacggataaactgccggtggtggatgcgcatcagcaacccctgggcgttctctactttagcgacctgcttcatcattcagagggccagtgatgcgacggttagccgatcctctgctgtggctggtgctgctctatctggggctgctggcggcaatgccttacagcggtccgctgttcgccgcctggtttcccgatcttgcccgtccgctctatcagcaggatagcttctggcagctcaccctggcgcacctgtttcttgtggtgaccgccagcctgatggccattatgctcggcgtgggaagtggcgtaatggtgactcgccatgcggggcgggctttccggccgctgctggaaacccttgccgctgccggacagacgatcccgccggtcgcggtcctggcgattgccgtgcccgtcatggggtttggcgcatggcctgctattgtggcattactgctttatgggttactgccgattttgcacggaaccttagcggggcttgatggtgtcccagccagcagccgtgagatcgcagtcggtgtgggcatgagcagttggcagcgcttgtggcaggtggaacttgcgctggcggcgccggtgattattgcggggatacgcaacgccgtcattatcaacattggcacggccgcgattgcctccacggtcggggcaaaaagcctgggctcgcccatcatcatcggtttaagtggttttaatacggcctacgtgattcagggagcgttgctggtggcgctgctggccatcgttagcgatcggctttttgagcggctccagcgccgttttagcgtgaatgaacgataagtgaatagccaaccagcataagtccactggtgccgccgatagccataatggcgaacagcgtggcaaaaaaggtttttttccagttcataaataacctgagggtgatgacgtcgaggcggggatgatagcgcgcgcaaggcagccgtcatagtgccgagcgtgcgtttttgtctcagtgtacgtcgtgcaaacgcacagagaatccctgttcctgccagtgtgccaactgttcctgctggcggcgcgtcagtcttttacccgtaaaaacaaacatattcagccccgggaacagctccggacggggaacgtcgaggggttctgcgagcacatcaatgcgccagccatgctgggataaacgccagccttccagccagatgcgcgtacgatcttcaatgccccagccaataatcagcgcttcctgaccggcttttttacgattgcaagccagacaaaacgccacatagtcgatcaaaatgccgtccagcaggctgcacatggtgcgtgcggtattttgatcaagactgagcttctgccttataggcataaaaacatgatcgattagggcatcgaccgcatattcgcgaccaattaaggcgattttattgcgtagcttagccggccttacatggcgcagtatgctgatgagttcgtcctgcatggccgtccagccatcatgggcgtcaacatctccaccttccagtagcgctttgactttgcccactggaactccactttcaatccagcgcataatttcctgaatacgctgaacatcttcttcatcgaactgtcgatgaccgccttcggtgcgttgtggcttcaagagcccataacgtcgttgccaggcgcgtaaggtaaccgggtttatgccacagcgctcggcgacatcgccgatactgtatacggtcatatttacctctttcactgacctgagtgagaccaccataacgaagcctgttaagttgtacaaccaatttttaggtgtacaacttgacggctgcgcttaaatgttgttctatctcaattatgagattttattttcataagtgagataagaatgtcttttgataatacggaacagcggttagcggctcgcctggcagaattgcgtctcaaacagggctggtcactggatgaactctctaccgccacgggcattagccggccaacattatcgcgtatcgagcgcggggaaaccagcccaacggccgcactgcttaaccggttgtgtgttgcttatagcctgacgatgtcgcgcctgctgagcgaagtcgaagagggcagcgatctgctgatcccccgtgaacatcagccggtatggaacgatgaagcgacaggatttagccgccgcaacgtttcaccgcccgcccataattttcgctgtgaacttatagaaggcacgctgcggcccggcgcgcgcatcgaatatgatgccccaccgctgcaaggcatggagcaacatatctggatgcgtcaggggcaactgaccataacgatgggtgcccagagctggttactggggccgggcgacagcctgcgcttccatctgaccggcgcgtctgcttttcaggcgcatcttaccgaaggcgctcgctacttactggtggtgtgtaaatcatgatgacatatcagcaactcagtgccggtgaggcactgcaggtcttacccgaactggttcaggttttacaggcctgtgtcgccgacggggccagcgtgggttttatcgatcctgacgacactgcggtcatgcagcttttctggcagagacagcttgatgggctggaaaaaggccaaagtgaactgctggtcgcccgccagcatgaccgcgtcgtggcgaccgttatgctcaactacagcgccatgcccaatgggggccatcgggccgaagtcagcaagctgctggtgcacccacaggcgcgacggcaggggattgcgcgcaggctaatgcagcaggccgaacaacgggcacgccagcaggggaaaaatttactggtactggatacgcgaacgggcgatgtcgccagcgatctttatcgtgccctgcactggcaggtcgcggggtcgattccatcctatgcacaatccattcacggcgaactggacgcgacaacggtgatgttcaagctgctgcaataaaagcctgcgcgcggaacgggtgcgtcagcctcatgcagtctgaagccctgggcaacgctcaccggcagtgtgcatcctggcatttagccaatagcatgcgccgccgtttcggaagccagcacgaaaaaacagacctgaaagctgacggcactgcgatactgtgtaaaaatacaggtcatttagtaaagcggtaatcttaacatggccctgacagcagcattaaaaagccagatagcacagtggtataaagcgctgcagcaacaggtgccagactttattcctcgcccggcccagcggcagatgatcgcggaggtcgcgaaatgcctgtcgggcgatgacggccgccatctggcagtagaagcgccaacgggcgtgggcaaaaccctttcgtatcttattcccggcatcgccgtcagccgcgcagaagagaagcggctggtaatcagcacggcaaacgtggcgttgcaggatcaaatcttcagcaaagatctgccgctgctcaagaaaatcattccggatttaacctttactgcggcctttgggcgcgggcgctatgtctgcccgcgcaatctggctgcgctggtggcagacgataatcagcaggccgacctgcttttctatctggacgatgaggcgatcagcagcaccaaagaagaacagatccagtgcggacggctgcaaaagtcactggaccgctaccagtgggacggcctgcgcgatcacagcgaggaaaacgtcagtgacagcctgtggcaacgtctgtccactgacaaagccagctgtcttggcgtgcactgccgctggtaccgcgaatgcccgttcttcattgcgcgtcgggaaatcgaacaggtcgatgtggtggtcgccaaccacgcgctggtgatggcggccatggaaaacgagtcggtgctgcctccggctaaaaacctgatgctggtcctggatgaagggcaccatctgccggaagtggcgcgtgatgcgctggagatgagcgcagatatcacgccgggctggaccagcctgcagcttgatctgtttgtgaagctggtggaggcgataatgagccagatgcggcctaaatcgccgccaccgctggctaaccccgaacgtcttaaagcccattgcgatgaactccgcgaactgttagccaccatcggtgaggcgttaaacccgttactcccgccgcacaatcagccgggcgaatttcgctttgtcctgggcgcattacctgacgagctgctggcgctgtgcgcgcggctgttcaagctgagcgacgggctacgcgggctgagtgaagggctgattaacgccctgagtgaacaaaccgggagcgtcgatctggtgcgtttacaccgcaatttattacagcttaatcgccactttggctggtttgaatccatcagcaaactgtggcggctggccgccatggaaaaagcctctggtgcgccagtttcaaaatggattacccgggaactgcgtgacggtcaggcacatctgttgttccactgcgcggggattcgcgtctgcgatcagctggaaaaaatgctctggcgtaagatccctcacgtcgtcgtgacctccgccacgctgcgctcattaaacagctttagccgtctgcaggagatgtccgggctaaatgaaaaggcgggcgaccgttttgtggcgctggagtcgccgtttagccatgtcgatcaaggcaagctggtgatcccgcagatgcgctacgaacctctgatggcaaatgaagcggaacatatcgcggaaatggcggctttttttcgccagcaaatgcaggctgaaaagcataaaggagtgctggtactgtttgccagcggacgcgccatgcagcagtttgtcgaggcgctaccggaattccgtctgacgatgctggtacagggcgatcagccgcgcagccgcctgatcgcgctgcaccgtaaacgggtagaacagggcgataccagcattttgatcggcctgcagtcgtttgcagaagggctggatttaaaaggcgagctgcttagccaggtccatattcataaaattgcttttccacccatagacagtccggtaattttaaccgagggtgaatggctgaagagcctaaagcgttatccgtttgaggtgcaaagtttacccagcgcctcttttacgttgattcagcaggtaggacgtttgatccgcagccatcagtgtttcggtgagatcgttatttacgatcgccgcctgttgagtaaagcttacgggagccgactgttagcggcgctgccggtgttttcgattgagcagccggtaacgcccgaacccgaggccataagcaccaaaccccataccggcacgcgtaaaccgcgtgcgaagcggcgttaagtcgttgccactgaccggaaatgcgtgatggaactgaataaaattatcaaagaagtggggcggggtaagaatcacgcccgtgatattgatttcgacagtgctgtggcactctacggcgcgatgctggacggcgaagtgccggatcttgaaatgggcagcattttaatcgctctgcgaatcaagggcgaaggcgaagcggaaatgcgcgggttttatcaggcgatgcagtcgcgggtgatgcgcctgcatgcgccagccggtcggccgatgcctatcgtcatccccagctataacggcgcgcggcgtcagggcaacttgacgccattactggcgctggtgcttaacaggctcggttttcccgtgctggttcacggtgtgagtgaggatgcaacgcgtgtcaccagtgaagccgtctttgcggcgctgggcatcgcgccggtcgccacggctgagcaggcccagtcaaaactcgacaacggtgagctggtctttatcaccatcgataacctctgtccgcccatggcaaaacagctgtcgttacgttggcggatgggcgtacgtaacagcgcccatacgctggcgaagctggcaacgccgtttgctgaacgcgaggcactgcgcctgtcgagtgtgtctcacccggagtatgtaccgcgcgtcgcaaccttttttagcgcgattgatgcgccggcgattctgctgaacggcacagaaggcgaggtttatgctaatccgcagcgctgcccggccatcagctatgtgggtggcgacgggcagcaggccgaagtctgggtggagagacagccggaagtcgctgtgtcgttgccaactgacaaatccgcagccgaaacggcccgctggacgcaagaggtgctgaatcatcagcgtcctcttcctgaggctctccgactgcaaattgcctgctgcctgcgcgccagcgctcagtgtgcgtcgctggacgcgggtctggaaagactgacggcggccggtttttaactgcgatcctgcggcagtgcgtgttccaccaggttttgccaaaagcgaataccggtgggaatcagcgcatcgttgaaatcgtagagggcattgtgtagcggtgcggatggggtggcaccatctgcgccaagccagaaataggcaccggggcaggcttccagcatgcaggcaaaatcttccgaagccatagagggattcacctgccagcgcgcctgttcttcgcccaaagtcctgacggcgacgtcatgcacctgctgagccgggccggcatgattggtggtcaccggatagccaggcagccagcgaatcgccccgcaaacgccaaagggtttcggcagcgtcgtcacaaaatcatcgataagcgtatgaacccgattgcgtacatcgtcttgcaaacaacgcacggtgccgcgcagaacaatctgttctggaatgacgttaatcgcttcgccgccgtgaatctgggtgacgctcaccacggcagaagacagcggcgacaggcgacgtgacggaatggtttgcagggccaggatcagctcagctgctaccaccatcggatcggcgccgctttccggcatagcagcatggcaacttttaccactcagggtaatttcaaaggcgtccagcgaggccatcatcgcaccggcgttcaccgccagcgaacccagcggtaagcccggccagttgtgcatggcgtaaacggcatccatagggaaacgtgtgaacaacccctcttcaaccatcttgcgggcaccgccaaggttctcttccgctggctgaaagataaaatgaactgtgccgctaaactggcgcgtggccgccagttgtttcgccgccgccagcaaaatggcggtgtgaccatcatgcccgcaggcatgcatcacgccgggtttactcgagcgccaggcggtatcgcctttttcgttaattggcagtgcgtccatatccgcccgcaggccgataaccggcccggtgccattttccagcgtgccaatcacacccgtacccgcaagaccgcgaaacacctgtaagcccgcctgctcaagttcatgagcaactttgtcgctggtctgatgttcctgatagcccagttcgggttcgcggtgaaactggtggcgccagcgcagcgcatcatcgagtagggcagaggaaagagtcatgcagtatcgcgctccatatcattcaggaagcttcactttagaggccgcgcgacagcgcgtctatcgccagaagcgataaaatggacaatgcgctaaatcaaaaaggaataagtaataaacaagcgtgcaggcatggcagattttatgccgatgcgcgttttattaaatgaaagccgatatcaataatgctcttcaaccgggcgctgctcgatacggtcagccagcagggttgcggcgcgttggcccatagccacccgatcgacgctaatggtggtgatggcaggccgattgctggcggcaaaaaagtctcagagaaaatcacgctggcccagttcaaaaacgtttgtgtcaaccgcatgatgatagggggtgatattgggccgttctgcgtaacctcacttacccggttctttctgacctggttccccacctacctttattgtcgggcctgtagatcgtattacgctgaactccgctaagtctgagtaaacctgttcatgcgttttactccgctgttccggacatgcatgccccggaacagcgtttttcagcttaacggtatctaaaaataccggcgttgtggtttattgcatgggtaagttcagaccatgttttgtcgcacaattctgtgccagctcgtagcccgcgtcggcatgacgcatcacgccagtcgcgggatcgttccacagtacgcggccaaggcgggcatcagccgcttccgtaccgtcgcacacaatgaccacaccggagtgctgtgagaatcccatgcccacgccaccaccatgatgcaggctcacccaggtcgcgccgcccgccgtattgagcagagcgttgagcagcggccagtctgacaccgcatccgacccatctttcatggcctcggtttcacggtttggcgaagcgacggagccacagtccaggtgatcgcgaccaatcacgatcggcgctttcagctcgccagtgcgcaccatttcattgaacgccagcgcggcaagatggcgctcacccagccccagccagcagatgcgagccggtaagccctgaaaggcgatacgttcctgcgccatatccagccagcgatgcagcgtcttatgctcaggaaagagttctttgagtttggcatccgttttgtagatatcttcaggatcgccagacagcgccacccagcggaacggccctttgccttcgcaaaacagagggcggatataggcaggcacaaagccggggaagtcaaacgcgttgctgacgccttcatccagcgcgacctggcgaatgttattgccgtaatccacggtaggaatgcccatatgacaaaagtcgagcatcgcctgtacatgtaccgccatggacgcgcgagcggccttttctacggctttgggatgggtttcccgctcctgctgccagcgtgcaacgtcccagcccagtggcaggtagccattgatgggatcgtgggccgaagtttggtcggtgacgatatcgggcttaggtccgccagctttcgcgcgtttcaccagttctggcagaatctctgcggcgttgcccagcaggccaacggagatcgcttttttcgcttgggtggcggcgtcaatcagggccagcgcctcatccagcgaggtggctttatgatcgacgtaacgcgtacgtaaacggaaatcgatacgcgactcctggcactctatcgccagcacgcaggcacccgccagcacgcctgccaggggttgtgcgccgcccatgccgcctaaaccggcggtcaggatccagcgtccgcttaaatcattgttgtaatgctgccgtcctgcctcgacaaaggtctcataagtaccctgaacaatcccctgggcaccgatgtaaatccaggagccagcggtcatctggccatacatcatcagcccggctttatccagctcatggaagtgatcccagttggcccagtggggaaccagattggagttggccagcaggacgcggggcgcatcggcatgggtacggaatacacccacgggtttgcccgactggatcaacagggtttcgtccggctgcagcagctggagcgagcgtaaaatttgctcaaaacattcccagttgcgcgcggctttaccgataccgccgtacaccaccaggtcttccgggcgttctgccacgtcggggtccaggttgttctggatcatgcggtaagccgcttcaattaaccagttggcgcagtgcagttcatttccacgcggcgcacgaatctcgcgtgccaccgcttttgtcagggtttcgctcattacggattccttatttaactgaatgtgtgcccatgctgggtaacaatgcggtgagtgcctgcggccagtcgcagcggcttgcccactgacgcatcgcctcgatgtccggagccagcaggcggtcttcctcaaggaaggccacgcgttcgcggatgctgtcgatggcctgctctatcagggcagaactttgcaagggacgatgaaactcaatgccctgtgcggccgccatcgcttcaatgcccaccacggcggcgctgttaaagcacatctcgcccagacggcgagcggcataggtcgccatggaaacgtgatcttcctggttggccgaggtcggtaagctgtctacgctgccgggatgggccagcgatttgttttcggatgccagcgccgctgcggtaacctgggcaatcataaagccggagttgacgcctccgtcgcgcaccaggaaaggcggcagcccggacaggccagtatccagcagcagggccagccgacgttcagaaatcgccccaacctcggcaatggctaacgcaataatgtcagccgcaaacgccaccggttcagcatggaagttgccaccggagatcacctcgccggtttcgctgaaaaccagcggattatcagaggcagcattggcttcaatctgcaggacgcgggcggcatgtgtgagattatccaggcaggcgcccatcacctgcggtacgcagcggatagagtaggggtcctgtacgcggccacagtgtgtatgtgatcccaggatctcacttccttcaatcaggtgggtgaccgcggcggcgacggcaatctggccatgctggccgcgcgcctgatggatacgcgcatcgaaaggctttaacgaccccttgatggcttctaatgacagcgcgcccgccattaagcctgcggcaaacaggttctcggcttcaaacaggccacgcagcgccagggccgtggaaacctgagtgccgttgagcaatgccaggccttctttagggccaagtacaaaaggcgtcaggccgacgctggccaggccctctgtggcggggatcagttcgcccttgacccgcacctgaccttcaccaagcagcatcagcgacatatgtgccagcggcgcgagatcgcccgaggcgcccaccgagcccttttccggaatgcagggcatgatgccggcattaaacagagccaacagggcgtcgaccagctcaatgcgcacgccggaatgacctcgcgaaaggctgataattttactggccacaaccagccgcgtcacactatcgggcagtaaattccctaaccccacgctgtgagacagcaccaggttacgttgcaggtctgcaagacgagccgcagggatttgtgtctgtgccagtttgccaaaaccggtattaatgccgtaaaccacactgccggaggcaacgatcgcttcgacggtacggtgcgcctcggcaatggcgcggcgggcatcatcgtcaaggctgagggtgacgttgccctgataaattgcgcgtaacgtcgcgagatcgacgttacctggaaccaggtgtaatacctgagtcgaacctgacataacctgctcctgtctatacaagggttgggttgccacagggcatctttattgaccctgatcaactgaataaagcgagtgaaacataactgtctattcttgtctatacaagttgcaagcggcgtgccaaaccgatcacaaaaatgatcgggcgtcagttctggggaggacaaatgatcaccgttattcctgcacctttatcaggcaacaggtgcacggataaagtgctgatggcgcgcctgaatgtatatacatccagcccttcaggcagtaaactctgagcattatcagtgaaaggaagacgttatggccgagcatacggcaattgcacaactggcggccgccatgagcgatgaaccggcgcccatttatcagcgggtcaagcaggccatcgtcagccagattcgtgaaggacactggaaagccaatcagcgggtcccctccgaaagcgagctggtcaatgagcttggcgtaagccgaatgaccatcaatcgtgctttacgtgagctgaccagcgaagggtttttggtgcgtatgcagggcgtggggacgtttgtcgccgaaatgaaaggctatacggcgatgctcgaagtccacaacatcgccgatgaaattgcccagcgcggtcatcagcacagttgcaaaatcctgacgatgggccagaacaaagccgatcctgagcaggcctctttgctggggctgaccaccgggcaaacgctgtttcattcgctcatcgtgcattacgaaaacgagttgccggtgcagttagaggaccgtttggtcaatccacagctggccccggactatctggcccaggattaccatacgctcacgccttatacctacctgatgcgggctgcgccgttaacggcaggcgaacacattgttgaggcggtgatgccagatgcgcgtcaacgtaaacacctggcgattgatgagcatgagccgtgcctcctgatccgccgccagacctggagcgacaataagattgtgacctacgcgcgcttgctttatccaggctcgcgttacaagctgcttgggcgcttcaaagcacacgggtaaggcgtacgaacaacagcctggcatcgctgctgtcgggttgtaacagggtggtgtgatccacccaccatgcaccctgctgtgcgtctaaccgcgtgtcacctgcgatgtgccattttccggctaaaacccatgccacgccgtgctcgctcaccacggcttccgtcacgacgtgggcctgcgcccgccattcaccccgccgcgtcatcacgttaaaatcctgactcggctcgttgccttgcagactggcctccagcgcccattcacccgcgaaagcccaggggacttcaggcagcaagcggtgttcgcatgtcgcgccgtgaagcaggaccgggctgccgtttagcagcgtaatagtgcgatccaccccgttgaaggtcgaaaacgggccgtcgcaggcgatggtcgcgatactggctcgccaggcgaagtcggcggcatcagggggaaagcggataatttcgcgtgtttcgcccccgccgttgcgccagcggctaacgggtaaactttgcagagaaaaaacacgtctcatcgcagggccgccattgcctgggcgaaacgggctgcgcaggcgtcttctgcagcatgatgcccgtcgctaatcacccggttgcccgccacatacacgtcgcgaatctgatcgcgctggcccgcaaataaccatcggttgagcagggcgcgttcatccacgctgcccagccaggctgcatcacgtaataccagccagtcggcgcgctgcccgacggccagggaaccactcttaatcccgcaggcctgagcgccgcccgccgccgcctgctgccacagcaaatcgccaaccgagggctggtttgccagcgtaatgcggttgcggcggcggtcgcgcagacgctgagcgtattcaagccagcgcagctcctcctggacgctgagcgaaacatggctgtcagagccaattccccagcggccgccctgggcgatatagtccaccgccgggaaaatgccgtcgccaagattggcttcggtggtcgggcacaacccggctaccgcaccgctgtcagcgaggcgcgtgatttcgctgtcatcaagatgcgtggcgtgaatcaggcaccagcgtgcatcgacctcaaaacgattcatcagccagctcaccggacgctcgccgctccaggccaggctgtcgttgacctctttttcctgctcggcaatgtgaatgtgaaccggtagcgagcgatcgctggcggttaacacctcgtggatttgcgcctcgctcactgcccgcagcgagtggaaacagaggcccacgttgtgcagcggcttgtctttcacccacgcctgcaggcgcgactgctgttgcaggtagcggtcggtctgctgaataaagcgtttctgtcccgccacaggaggctgcgcgccaaaaccgctgtagctgtaaagcaccgggagtaacgtctgaccaatccctgcgatatcggcggcggcaatcagctgctgcagcatcgcatcatccgcatagggctggccgttaacgtcgtgatgcaggtagtgaaactctgcgacctggcagtagccaccttttaacatatcgatgtacagcagggcggcaatatcgccgacctgttgtggcgtcaggcgctgtaccatgcgatacattagatcacgccaggtccagaagctgtcctgcggatcgcccgccacttccgccaggccggccatggcgcgctgaaacgcatgggagtgcagattcgcgatagcggggatcacctcgccgtccagacgtgttgcctggctgtcatcactgtcgggcgtgatggcatcaatcaatccagcgggactgacgctgatgcggacctgtttatgccagccatccgccagcagtgcgcggggcgcaaaaaaaattgccatagttgatcctcaagggatgtagttgtatatacatatacatactttaaaacagactgtaaacggcgagaacaacgagaggcaggaatggcagaagaactccaggtagacagtgtgtggaccggtgccgatgtggtgaccatgcgcggcggccgctacgcgattattgaacagggcgcgctggcggtgaaggcagacaagctggtgtgggtaggggccgcagccgatatgcctgcctttatcgcgcaaaaacatcaccggctggcgggcggtatcatcacaccgggactggtcgattgccatactcacctggtttttggtggggaccgcagtcaggaatttgaacaacgtctcaacggagtcagttatgcggacattgcggcacagggcggagggattctctctaccgttcgggccacgcgcgcagccagtgaagcggaactggttacatcggcccgctggcggctgaatcgcttactggccgagggcgtgaccaccgtcgagatcaaatccggctacggtctggataaagagagtgaattacgcatgctgcgcgctattcgtcagttgcgtaacacggtggccgcagatgtgcaggcaacctgccttgccgcgcacgctttcccgccggaatttaaacagaatcctgatggctggatcgcaattatctgcgaacgccttctgcctcaggtcaaagccgaaggcctggctgatgcggtggatgccttttgcgaacatctggctttttcacctcagcaggttgcgcaggtgtttgagcgggctaaggcactggggataccggtaaagcttcacgcggagcagttgtctgcgctgggtggtgcggcgctggccgcgcgctatggcgcactctcagccgatcatctggaatatgccaccgaagaggatgttcaggcgatggctgaacagggtactgtcgcggtgctgttgcccggtgcattttacctgttgcgggaaacgcagcgtccgcctgtggcgctgtttcgacactatggcgtgcccatggcgctggcgagtgatgccaatccgggcacctctccggccctgtcgctgcgtttaatgctgaatatgggctgcaccctgtttggcatgacaccggaagaggcgctggcaggcgtcaccttgtggggggcgaaggcactgggactggaggcgagtcacggctcgctcgaagcgggcaaagtggccagttttgtccactggccgctggcacgtccggcggaactcgtttactggctgggcggcgaactgccctgtaccgtcatctatcgcggagaaacacaatgaccccttttcatttcacgcagggcagcattcccttactggtcagcattccccatgccggtacgctgttgacgccggacgttgaggacggactgagcgaggccgcccgcagtttacctgacaccgactggcacattcctcaactttatgattttgtccgtgatatgggggcaagtattatcattggccgctactcacgatttgttatcgacctcaatcgcccttccgataatcaaccgctctataccaccgccacgaccgggctctttcccgaaaccctgttcgacggtacgcccacctttgctgaaggtaaaacccccacgcaggcgcagcgccagggctacgttcagactatctggcagccttaccatcagcagatccagcagacgctggcacaaatgaaagcgcagtttggttacgccttactgtttgatgcgcattccattgccagtgaaatcccgcgtctgtttgagggccgactgccggatctcaatatcggcacgaacgacggggccagctgcagcagcgccgttattaacgggctgacctcggtgtgcagtgcgcaggatcagttcagttgggtggtcaacggtcgtttcaaaggtggctatatcacgcgcgcctacggccagccacagcagcaggttcaggccgtgcagctggagctgtcgcaaatcaactatatggatgaaagcccgccgtttacctggcatgaagcgcgcgctgcgcagctgaagaaggtgttaaagccgctgctgcatagctttctcgaacagggaaaaatgggctgagacgtaatccgagcaaccgaaacagccaggcgggttgtttcggcgacatgagactaacgggcgtgatgtgtgtctgtcacgccagtcccattgtcatggcattgcctcgccgggcgtgacgcgcgcctaccggcagccgctttttacgcctttcccgataacgcggaacgatgacgctcagcacagcgtgctgcacgtgggataccgcccgttcaggtactgtccgcaggtggcgggtggcctgagcggtcaggttaaaccctgagacggttccccaaaaaacctaagaagtgctgacagaaacccagggtgcttatccgcgccgcttaacatgaacccacaacctgccgccagacggtttttgcgctaaattcgtgcagcctttgcacgtttgttgtgcatccgtctgtcggctgttgcaacacccaacccttgtgctgctggggagaataacgaccaatctggcacggcctttgctagcttgtatgtacaagtaacctctgaacgaaaccccgttgttatttatcgtgtctggctcacaaaaacatcaagccgacaatgaactcgataacgttaacttgtatatacatgactcatcatcttgtgaattttttgttaaaacaacatcgatgctgttaaaacctttttcatccaggagaagccgtatgaagcaccacgtagcgtttcgccgtttttgcctcacgaccctgttttccagcctgctgctcagcaccgttgcggtgcaggctaaagagtggaaatcgatcacgatagccacggaaggcagctatgaaccctggaacctgacgctgcccggcggcaaacttgggggttttgagcctgagctgatggccaacctgtgcaaacgtatgggcatggagtgcaagctggtggttcagaattgggatggcatgattgccgggctgaatgccggcaaatatgacgtcatcatggatgccatcgtgatcacgccggatcgtaaaaaagtggtcaacttcaccctgccttacgcctccacacccgcgacctttattaccgtcaaaggcacgctgttgccgccgggcaagggcgtgacgaagttgcatgacgatgagaaagagattgaagccgcgctggcaccgttaaaagccgcgctgaaaggcaaaaccatcggtattgcttccggcacggtatatacgccttttatcgacaaatatttcaagggcgtggctgacatacgcgagtacaccacctccgccgatgccattctggatttgcaggccggacgtattgacgcggtgtttgatgacgtgacctttgccaaatcgatgctgacacgtaaagacaacagcaacctgaccttcagcggtccacagctcggcggtcccatctggggtgaaggcgaagctatgggtgtgcgcatggcggacaacgacctgaagaccaaactggacgacgcgattaaggctgcgctggctgacggcacggtgaaagaacttagcgaaaaatggtttaaaactgacgttacgccataagtgaggtcgagcatgatgaacctgctgggttttggcgcagagggctggggatggctgattgtcagcgcaacgcttaccacgttgctgttgtcgctggtcgcgctaatggtcggtgccatcgtgggctcagccatcgccgccgcgaaactgtcgtctcatcgccctttacgctggttaggcgagggctattcggtgatttttcgcggcatcccggagctgttagtgatctacctgttctacttcggtggatcgggcctgatcacgcagatcggtcagttattcggtgcggaagggtttattgaagcgccgccgtttctgatcggtgctctggcgatcgggcttatttcaggttcctatcaggcagaagtctatcgtgcggctcggctggcgctctcccacggtgaagtggaagcggcgctggcgataggcatgtcacgctggcgtcttcgccagcgcatcctgctgcctcaggtggcgcgctatgcgctgccgggcttatccaatgtctggcaaatgagcctgaaagactctgcgttggtctcggtgaccggcatcgtggaactgatgcgcgccagtcagatagcggccgggtcgacgcgtgactacttcaccttttacctgatcggcgggggatgctatctgttgttaaccatactgtcgaatcgggcttttctgcgcgcggaagcccggctgggccgtgcctggttaagccggacagcggcacagcattaaggaactgcaccatgatcgattttgcctttcttgctgatacctttcttaggttaagcgccgcactgccggtcacgctcggcctgttcatcagttcattcctgtgcggcggggtgctggcggtgggcattctggcactgcggatgagccgctggcgtatcctgagcggttttgcccgtggctatattctggtatttcggggctcgcccttaatgatccagctgtttttaatctattacggcctggggcagtttggcgtgattcggcacagttttgtctggccatttttacgagagccgttcagctgtgccgtgctggcgctatcgctttgtaccgcagcgtatacggcagaaatattgcgtggtgcgttgctggcggtgccagccgggcaggtggaagccggtatggcatgtggtatgtcgcgctggctgctactgaggcgcattattgcaccggtcatgttgcgctatgccttgcccgcctattcgacggaagccattctgctggtcaaatccaccgcacttgccagcctggtcaccgtgtgggatgtcaccggggtggcgcagcagattattcagcgcacctaccgcacgatggaagtgttcctgtgtgccgccgcgatttatctgatccttaattttattatcgtgcagctgtatgccctgctggagcgtcgtctgacgccggttcatcagccagcaaagaagccgttagcggccgttaagcccatcactggaggggaatgagatgcaggattcatccaccgttacgctgtccgccagcgatattcataaatcattcggcaccatggaggtgctgaaagggatttcattacaggcccataaaggtgatgtgatttctattctcggggccagtggatcgggaaaaagcaccttgctgcgctgcattaacctgttggaaacgcccgattccggcgtggtaagcgtcggcggggaaaccattgaaatgaagcgccatgcgcgcgggcatcaactggccgctaatcccaaacaggtcgaacgtttgcgctcacgccttggcatggtgtttcagagctttaatctctggtcgcatatgaccgtgctgcaaaatgtgattgaagggccgcactatgtcctgaaacgcgataagaaaacctgcatcgctcaggccgagcaattactggaacgcgtcggcctgcttaatcgcaaaggcttttatccggcccaactgtcaggcgggcaacagcagcgcgtcgccattgcccgcgcgctagccatggacccggaagtgatgctgtttgatgagccgacctcggcgcttgacccggagctggtgggggaagtgctgaaggtcatgcgcagtctggcagaagagggacgcaccatgttagtggtgacgcatgaaatggggtttgcccgtcacgtgtctaatcgcgtggtgtttatgcatcagggcagcattgactgccagggcacgccagatgagatgttcggcgagggcggctcggcgcgcttcaggcagtttatctccagccaccatacaccggagtctgtgttatgagtcgcgttgttatctggggggatgcccccgtaacctggcaggaggtggtcgcggtggcccgccatgatgccgaactggtgctgagcgagcatgcctggcagcgcattgcccagggccgggagattgtgacacacatcgtcgcgagtggtcagatagcctacggcattaacacagggctgggtgcgctgtgcaatatcatgctggcggaagaagaattgagtcagctgtcacgcaataccttattaagtcatgcctgcggcgtcgggccgctgctggcgaagcaggaagtccgcgccatcgtatgcgccgcgatagcgaattacagccacgggaaatccggcgtgtcggttgaactggtgcgacggctgttggcgttgctgaaccagcacattactcctcaggtgccctcacaggggtcggtggggtatttgactcatatggcacacattagcctgacgctgattggcgtaggcgaggcggaatgccaagggcagatcctgcccgccagtgaggccctgacgcgagccggactcacgccttatcgacccggagcaaaagagggactcagcctggttaatggtacgccgtgcatgaccggactggcctgcctggcgctggacgatgcgcggcgtttgctggactgggccgatgtcacgggggccatgagttttgaagcgttaagagggcaactggtggcttttgacgaagaggtgctgtccctgaaagccagcccgggtatccagcgcagtggcgagcggttacggcggttactgggcgacagcccgctgttaaagataagcagtggcattcggacgcaggatgcactgagcctgcgatccatgccgcaggtacacggtgcctgtcgcgatcagtttgcacatgcagagcgtcagatagaaaccgaactgaacgcctgcaccgataatccactggtactgggcacaccccaggcctggcgcgtggtctcgcaagccaatccacatggtgaatccgttgccatggcctgcgatctgctggcgattgcgctggcagagctgggcagtattgcggagcgacgtctggaccgtctggtgaatccactggtcagcggcttaccgccttttctggttgcccaacccggcgtcaactccggcatgatgattgcgcaatacgtggcagcctcgctctgtgctgagaaccgccagctggcgcagcccgccgtgctggataactacattacgtccgggctacaggaagatcacctgagtctggggaccggtgcggcactgaaattgctcaagaccgtgaataacgtttatcaaattctggcgattgaatacctgctggccgcccaggcgctggagtttcacggtgaagaacagctggcacgcagaacccttcaggcctggtgccaactgcgtcaggtggtgccgagctggcaggacgatcgctggctggcaccagagattgcccgcgcagtaaatgtcatccgcgcgcatcccgcggatgcactctgacgcttacccccgacgcgcatccgggcgcaccaaatcaaagcgctgcgcctcactgataccgtaataagcgctggggccgccagcgcgcaaaatcggttcggctttcgccgtctgataaatgccgttttccagtagcgtttcatcaatgtggatggcgacggcttcacccagcaccagccagctgtcgagggcgttgccgtgcgcatcctgcaactgaataagctgcgtcagtttacactcaaaattcaccggactttcctgcaccagactggcttcaacctgcgaggcggcaaggggcgttaaaccggcaagggcaaactcatcctgatcggcgggtgcagaaatggaactttcgttcatggcttcagccagcggccgggttgccagattccagacaaacgctttggtttcagcaatattttgtacactgtctttccagccgctactggcgaaaccaataatgggtggctggtaattgaaacagttaaaaaaactgtaaggcgcaagattgcggatgcctttggcgctgatggagctaatccagccaatgggacgtgggccgataatggcgttgagcggatcgtgcggcagcccatgtccggcgcgaggctgataagaataacgtttgttcatggttgtctccctgtaaaagctgattcaagcgtagtgggtaaatggctgttgccgtggcaaacctgtaaaaaggcctcgatcaggcaccggattattcctgaataataacagccgttactttctgtgctaacgggtgaatttttatttatatcagttagttaaatattatttaccgattttgctactgaaaacaggtggtgcaaaagtaaacgaaaagtaaacgagtacattttatacatttcgtgctagcaaaggtttcgtatttgtttaacgaaaatagcgcaatatacaacctcatcaattgttctcgtggtcgatatgaaaaaaattcttgttacaggatcttctggattcgttggtggtgcagtcgtggcagaattgctgatgcgccaggatgttgagttgctgctgcttgtcagagccagcgatgctacccagggactggagagggttaaagataatttatctaagttttcatgttcggcacaggctattcagcgcctgaccgcagatcagattctggtcggcgatctcctggcgcctgaactgtttctggatgatgcacgcatcgatcaggtcagccacgtcattaactgcgcggcgattgcgtcatttggtgaaaataacgatatctggcgggttaacgttgaaggaaccttcaaactggccgccagaatggcagcactgcctgcgttcgtgaaatttgtccacgttggtacggccatgtcttccgcgccggatcagggtgaaatcgtaaaagaggatctggtgctgtcttcccgtgaagatcacattgtcgattacacctattccaaatcctacattgaaaacaagatcaagcaggaactgcctcatttgccgctgatcattgcccgcccatccatcgtggttggccattctcaggaaggttgtacgccgtcaggcagtattttctgggtattcaagatggtgatgaagctggaaaaattcctctgctcacttgacgaccgcgtcgatgtgattcccgtggactactgtgctaaatcattggttttcctgctggatcatggctgtaccaaagagatggtttatcacatttctgccggtgaacgcagcagcaataccttctctgaaattgattcggcgtttgccacagcagaaaaaagtgcaccgctggcacctaactatctgcaggttgatttcagcgagatcgttaaagagcgcaagaacttcaaaaagatttatgggccttgtaatgaacgcctgatgctgcgcgcgatgcgcctttacggtgagttcgcccgcctgaatgtggtgttctctaacgacaaattgctgcgcctgggtatgagttcaccgccaggctttaccagctatatcgatcgttgcgtagaaaccacgaaaggtatgccaatccaggatttaatgcgcgtcgattttaaataatcccgcaggcttatgatgcgccaccagcacgtttgctggtggcgcattttttattgctaagctaacgtcttccttctttgcctgcgcttttattccctgtcattgataccgcaaacaggcgattccaccgcacagggcacattaacttatccgccaccctgtcttcatgcagccgagaatgctgtttattttctgccagccacagcgtattgtacgcgcgcctgaaaacatgagagaacgtatgaaaaagtcagccagcccgtcgctattccacgcccgaaaccgccatcaaggtgaatatgattttgctgccctcacggcggcacatccgccgctggccgcaaaagtccggccaaatggttatggcgtgatgtcggttgattttgccgatcctgaggcggtgatgttgctgaaccaggcgctgctcaaacttttctacggacttgactggcaactggccccgggatcgctctgtccacccgtgccgggacgtgctgactacctgcattatctggcagatttactggcactggataaccaaggcaagatcccttcggcggacgtgttggatattgggtgcggggcaaactgcatttatccgctgattggggccgctgaatatggctggcgttttaccgggaccgaaattgatgaagccgcgctgaaagctgccggtaaaattgttgccgccaacgccggtatgcagcgcctgatccgcttacgccgacaaaaaaatccgcaggcggtgctgaatggcgtggtgaataaagatgcgtttttccatgcggtcatctgtaacccgccgtttcatgcgtcggccgaagaggcggcggcaggttcacagcgcaaatcgcgtaatctgggtttacagcctgccgcaccgcttaactttggcggtcagcacaatgagctgtggtgtgaaggcggtgaaaaagccttcgtggggaaaatgattgcggaaagcgccggcatggcgaaccaggtggtgtggtttacctcgctggtatcgcgtaaagagcatttgcctgccctggaaaaacaactaaaagcactggagaccgaagtcgtgcgcgtggtgaatatggcgcaggggcagaagcagagccgttttctggcgtggagctttatgcccgccgcccagcgcgcacaacggctgtctcgctaacacagcagcccgcaacgggctgctgtgttaatcactcaggtgacgtgctgtaaaaattcgcgcagacgttcgctgggagggtgactgatcaggctgtcaggatcaccgtcttcggcaatacggcctttatcgataaagatcagccgtgatgccactttctgcgcaaagccgacttcatgcgtgacgataaccatcgtcatgccttcttcagccaggtcctgcatcactttcaatacttcatgacgaagttccgggtccagtgccgaggtcggctcatcgaacagcatcattttgggcttaaccgccagcgcgcgcgcgatcgccacacgctgctgttggccgccggatagctctgaaggaaagtgatgggcgcgctcggccaggcctactttagccagcaggctctgcgccagtttatgcgcctcttctttgctggcaccgcgcacccgaatcgggccgaatgcaacgttatccagggcactcatctgtgggaagaggtgaaactgctggaacaccatgcctgcttcctgacgaatcagacggtcgtcgactttaggatcgttaactttcaatccatcaacaatcagctcgccgctggtaatctcttctaatttattgatacagcgcagcagggtagatttaccggaaccggatggaccaataatcaccaccacttcgccctgcttaatattcaggtcgatattgtgtagcacctgggttttgccaaaatgctttgagacgtctttaaattcaatcacaggattttcacccttttctcaatgcggcgcagcacaaagctcaacaccagcgtaatcacaagataaataatcgcgaccgcactccagatttccagtgcacggaagttaccggcaataatttcctggccctgacgcgtcagttcggccacaccaatcacaatgaacagggacgtatctttaatactgacaatccactggttgccaagcgggggcagcatacggcgcagcgctaagggcataatcacatagcgcagggtttcacggctcgacaggcccagcgccagtccggcttcgcgaaaacctttattgatcgacagcaccgcaccgcgcgtaatttcggcaatataagcgccagagttaatcatgatggtcaccacggcggcggtgaaaggatcgatacgcaaatccgggaaggccattggcagggcgaagtaaataaacatcacctgcacaacgataggcgtgccgcgaataatttcaataaagaccagggcaatatgattgcttatccagccgccgtacgcgcgcgcaaaccccgcgaccagaccgataattaacccgcccaccaggccaatgatggaaataattaaggtcattttcgcgccttcgagcagcgctggcatggctggccaaatgacgctccagtcaaactccatggtgaaactccacttgtgttgcgatggaaaaaagcagggaaatattccctgctgaaaaatgaacgcagactcagttattatttaggatcggtgccaaaccactttttataaagcgtgttgtaggttccgttttctttcagtgttttcagcgcgccgtttactttttcacgcagttcgtcactgcctttcgggaaggcaataccgtactgttgtgcttcaatcgattcgcctaccgctttgaagcggcctttaccggcagtattaatgaagtaaaggatgtttggcgtatcatgcagtaccgcgtcagcacggttggtacccagttccatataggcgttatcaatattagggaactgacgcaggtctttcgttttgatgtggctcttagcgtaatccactgaacccgtaccgctcttcactgcgaccactttaccattcaggtcgttaatgcttttgatgtcattttcattgttgcgaaccattaccagcagaccacttttatagtagccatcagaaaattcgatcgcttttttacgctcatccgtaatggtgataccggctaacgccaggtcaacgttgcgcgtttgtagtgcagggatgatgccactgaagtccatcggtttcagggtataatccagtttcaattgttttgcgattgcatcccacaaatccacatcaaaaccaacatacttatcaccctgtttaaattcaaaagggacaaatgcagtatcggtggcgacgatgagtttcttttcggcggcggtagcagagagggagaaggccagcgccagcgcggccacagagatgttaaacaacgatttcatcatttttccttattacgaccaggcgtcaaggcccaggtttgcgagctatcatatgaaaaaaatatgccaactttgcaaaatacataaaatcgactgcctgacacaaaatcgctgacacgattctgcacggggaagtgagtttgcactaattgagtgcttcatggtggtgcatagtgctacggtggtgcagaggtagtgtgcatcagaagggaaaaacaggaagagcaggaagtgaaaactgttaacaaagtcataaaattataataacacagacgtaaaaaaggcgggtttccccgcctgtttacagtctactgtctgacattattcaatgttggactcgataaaccacaggaatttatcaaggtcacgcgatgcggcagtgaaaatatctgcggtatcttcatctttcacttcagaaatggctttgcgcgtgtcgttagcgacaacgctgtagcgatcggccagcgctttcaggtgatcctgaacgctgtgaatattcagcggatagcttttcagtggcgtcttgtcgttcaccacctgggttgtacccagtgcgacgccacccagctgtaccacgcgctctgcgatggtatcctggtgatcggtaatcgcggtgcggaagccgtccagcatttcgtgcacaccgataaagtttgcgccacgcatgttccagtgggcttgcttagtgatcagtgacagatcaatgaactccactaccaggcgattgagcacctcaatggtggctctcttttcgtcatctgccacgtcattacgggtgtaaagtagatcagaagattttgttttaaccagtttagcggtactcattgtttcggtcctctctttcaatggttgtcctaatcaagtacgagattgagtatagcagtgattcagggctttgcaggattggcttaatcaatggctgaaatagtattcgccttcgcaacggtcagacagtgcgtaaacgagttaataaagtgttaaatttaccagcaagtaaaagtattataaaatcataaggttaaataattattcaatgagcaggttgtagatgttctaaatattaactttctattacattttagatgaaaataattatcaggatgatttttagtgttatttagcctgtttttcaacagggtgacgcgcattattttttaacgttatccgtcactgcaatctcattcagctggctctttctgggacgcatcgtcagggttgcacctgcagacgccaggataattgccagtaacgccaggcactgcgttcccgacaggctctcgttcagatacatcatgcccgacagggccgccactgcgggttcaaggctcatcagcgtgccaaagatccgcgctggcaggcgcgttagcgcaatcatctccagcgaatagggcagcgccgtggaaagaaacgccaccagaaccgcgacgggaatgacgctccactgccagatgccacttgccgcaaatgtcagcccgacggggacaaacaccagggaggcaattaaggagccgatagcaacggtggcagcaccgtgctctgcgcccgcccgctgtcccgataagatatagcacgcccaacaggcacccgcacccagcgcaaacagcgcgcccaccggatcaacggaggcaatgccggtgctaaacggcagcagaaaccagagtcccgccacggcaaggatgacccagataaagtccagtgcacggcgtgagccgagcagcgccagcgtcaatggaccaacaaactccagccccacggcaatgcccagcgggacagtgcggatagagagataaaacaggaagttcattgcacccagcgacaagccataaataatgagtggcgtgcgttgctcccggctgaaacgcaactgccagggtttaaatatgacgcacaggatgagcgtgccaaatcccagacgcagggcagtaatgccggtggcaccgacagtgggaaacagggttttcgccagtgaagcgccgccctggagtgacagcatagagatgagcagaacgacgacaggaatgaagactggcgtaaatgactttaacgaagtggctgacatcctgtaggcgcttcccgatcaatttagctaacaagatgaccagtgtaatggaaatgcaggtcaaaaagagggcgcaaagtgattttaattttttctgtttggttggtttttgagcaaaattacgggcagataagtaaattaatgtcaggattttttaggaattaacttaaagcatgaaaatttgtttaagaggtttgttgcaatcatatgacgtattttataagaaaaaagaatgacataggatacttcattaacttcctgttacaccaaactatgtgttagacaacaaaatgcgggcagagtttctcgctattttttgttatattttcagcgttgtcaggagagaagtactttcacatttgaggtggttatgaaaaaaattgcatgtctttcagcattagcctgtgtgttagcagtagcaacaggttccgccatggcacagagcaccgtaaccggtggctacgcacagagcgactaccagggcgttgctaacaaagcaaacggcttcaacctgaaatatcgttatgaagacggttctaacccactgggttggatcggctcattcacctacaccgagaaagatcgtaccgaagatggcatctacaataaaggccagtactacggtatcaccggtggtccagcattccgtctgaatgactgggcaagcatctacggtgtggttggtgttggctacggtaaataccaggctaacgacaccacgtcacgcgacaaagcagacaccagcgattacggtttctcttacggcgcgggtatgcagttcaacccaatggaaaacgttgcactggacgttggctatgagcagagccgcatccgtagcgttgacgttggcacctggatcgctggcgtaggttacagcttctaagttagcgtagtcgagttttaaaaaacggcccttttcagggccgtttttattggtaacgaaaaataagccgtcagagagtatctgagtagccatagggcaatgccagatagggtgtgaagacctgagtgcagatgccacagcatcactgtagccttagaggcacgatagggcataaagacctgcgcacagatgctacagcatcacagtggctgattgcctgcccatgagtgctgccccgtcggagaaatctgccgctggcgcaaccgtcatccgcaactggacttcgccgatgccagagaagggcgcgctaccgcaggcgacggtctctgcctgttataaagggcgcagataagggatgattcagggggacggaagcagtacagacgtacgaggggagcacagataaacggcaggcggggtcagcgcggcaacagaagaagcccgcgccttcaggcggtcagccaaaaggcgatatcagctatcagccgcgccagatcagtttttgacagtgacgttcttccggttcattccccagaagtttgtttatcaacatcaggcgcagtgtaaaaggggaacgggtcagcaggcaccaccaggatttcatacctgatgttgatttttctgcctggaagcatttgctgcagtcaacacagcttttcagggtgctcataacatcacctcccaataaatttaacgcaacggtaagcagagcggcctaatcgtgctttaatgcatcactctgtttacattatcgacaaatatagcattggctatatcatttagccaaggctaacgacgaaaaatttgagcttatttgcgcctggtttacaatgagcgcagctaaaaccacatggcaggcctggtgtggaaaaaataaagaggaagctgaatgagtcgtcgtgccaaaagcgtggtttctgccccgcaaggaccactgaaagatattgaagagcatgtcgaaggttttcggcaggtgcgcgaggcgcatcgtcgtgagctaattgatgactatgttgagctaatctctgatttaattggtgaatttggtgaagcacgtcaggtcgatatggccgcacgtttaggtgtttcgcaacctaccgtagcaaaaatgttaaagcgattaggtactgccggactggttgagcaggtgccttatcgcggtgtctttttaacacgtgagggggaaaagctggctgaagagagccgtgcccgccatcatattgttgaaaccttcctgttagcgcttggtatcagtccggaaacggcccgtcgcgattcagaaggcattgaacatcacgtgagtgatgaaacgctggctgtattccagaaattttacgaaaacaattaaccctcagttaaggcgccggacatcatgcccatcgtgcttcgctcatttttgcatgaccatatattgcacttgttagtcgttgttggggttgttctgctgtttcttgctgattatcgctggcctgatcttcccgccgcggtggactggcataccatcatcaccctgagtggattacttatcctgacgaaggggttggaaaccagcggttattttgatgtgttgggtggccgattaattgcgggcttcaagcatgaacgtacgctggcgctgtttatggtgctggcggcggccctgctgtcgacctttttaaccaacgatgtggcgctgtttattctggtgccactcacgttgacgttacgtaaattttcgcatttacctatctcgcgcttgattatctttgaagccctggcggtaaacgccggatcgctgctgacgccggtgggcaatccacaaaatattctgttgtggagccacggctcactgagcgtgggcggttttattttgcaaatgacaccgctggcggtgtggcttctgctcagcctgctggtcgtcacctggttcagctttgccaaacgcaccattgaaaagcatgacaacagtgaacagcacagctggcataaacccctgtttgccgtgagtgtggtgttgtatctgctgtttattgccgcgctggaatggcatgtcaccggctgggcgctgttgctgattctggtgtgtttcctgattatggcacgtcaggtattgctgaatatcgactggagcctgctggtggtcttcatcgtgatgttcctggatgtcttcctgctgacgcgtttaccggtaatgcaggcacatttcgatgccattacccatcttggcaaaggggaactctatctgctggctatcggcttgtcgcagatcatcagtaatgtccctgcgacgatcctgctgttgcaaaaagtgccgccaacggaagcgctcgcctgggcggttaatatcggtggattcggtttgttacccggctcactcgctaaccttattgcgttacgtatggccaaagaccgcgccatctggtggcgtttccacctgttctccgttcctttactcgcctggtccatgctcaccggctggctgttgctaaaactcgtcgcctgatccagacacatcctgccacggtgcaggatgtgctgcctttctcaagttacgtaaagttgtactggattttgtcagttttcgatctaatgtttagtggactttctacgcccaggatagagggccttagccagcgacggaaactatgagcgagaacaacaaccgcgattcacatcaggaagacgcagaacacgcgccggataacaacagccagtcccacgacaacccaagtaataacgatgaaaaaccgcgcaaacgccccggtaaaaaaccgttaattattttggccgttatcgtggtggtgatggtgatcgtggcctttttcttttggtttaccacccgtaacgaagaaaccactgacgatgctttcactgaaggcaatgcggtaactatcgccgctaaagcgtctggctatgtcgtcaagttactggtgaaagataaccaacgggtgaagaagggcgatttactggtagaaatcgaccccagcgacaacgaagcccagcgcgcccaggctaaagctcagcttggtctggcaatggcacaactgcatcaggcccaggcgcagctcgcgctctcacgtgttcagtacccggcccagcgcgatcaggctctggcagaccaggcaaaagccgaagcaaattacctgaatgcgcaggctgactaccgtcgtcagcgtggcgttgatcctcgcgctaccagccaacgcaatattgactcggcttctgctcagttgcgttctgcgcaggcccagttgcagagtgccaaagcgcaggtggaagttgcctcgcaggttgcgctgcaaatccgccagcaggaaaccaatgttgaagcacgtcaggaacaggttgagcaggcaaaagcccagctcaacgtggcggagctaaacctctcttatacccaggttcgtgcgccttacgatggctttgtgacgaagcgcaacgtgcagatgggcaccctggtgcaggcaggcagcgccttgttctcgctggtttctccggatatctggattaccgccaactttaaagagtcgcagttggagcggatgaatccgggtgacaaagtgacgatcagcgttgatgcctggccggatatgaagctggaaggccatgtcgacagcgttcagatgggcacaggatcgcgtttctcaaccttcccgtctgagaatgccaccgggaactacgtgaaaattgttcagcgcgtaccggtaaaaatcgtgattgataaaggactggatccaaaccggccgctgccactgggattatcggttgaaccgaaggtaaccgtggaatgagcgaatcgcagagctggaaacccgccagtaatccctggctagtggccattacggtcacgctggcggtatttatggaaattctcgataccaccatcgtaaacgtggccctgccgcatatcgcgggttcactctcctccagttacgatgaatcgacctgggtgttgacgtcgtatctggtggcgaacggtatcgtgctgcccatctctgcctttttcagccgtctgtttggccgtaagcagttttttttaatctgcatcgtgatgtttaccatctgttcattcctgtgtggtatcgccactgaactctggcagatcattctgtttcgcatcctgcagggcttttttggcggtggcctccagcctgtacaacagtcggtgctgcttgactatttcaaaccggaagatcggggcaaagccttcggcctttcttctatcgccatcatcgtggcaccggttattggcccgacgctgggcggctggattacggataattacagctggcgctgggttttctttatcaatatcccggtcggcgtgctgaccatcatggccattttacctttgctggaagatccgccatgggagcgtaaatgggccaagggtaaactcaagatcgactatatcggcatcagcctgattacgctgggcctgggctgtttgcaggtcatgctggatcgcggtgaagacgaagactggttcgcctcgcactttatcgttttgtttgccgtgctggcgcttgtgggcatcgtcggggctatttactggttaatgtatgcacgcaaacccgtggtcgacattctggtgatgaaggatcgcaatttctgggtcgcaggcttattaatggccgggatggcgatgatactgtacggcagctcggtggtcttgccgcagttggcacagcaggatcttggttataccgccacctggtcgggactggtgctgtcccctggcgcggtgttgattgtcctgaccattccgctggtcttgaaactgatgccggtggtgcagacccgctatattattgcctttggttttagctgcctggcattagcctttttctattcggcgagcttaacgccgaatgtggacttcaccacgctggtgctgatgcgcagtgcacaatccattggcctgggtttcctgtttgtgccgctgaccaccattgcctttattacgatcccccaacggttaaacgcggacgcctcggcgctgtttaccatgttccgtaatgtcgcggggtcgattggcatctccttgtccacggcggcgattacagagcgagaacaggcgcgctcggcccatatggtgcacaacatgacgccgctgaatgaacagttcaatattacggttcagcactgggcacaggcgatccgcgacttcacctctgcggtgggcgatcccgtcacgttggcaaccggtcagctctataaagagatgattgtccagtcacgcattctggcttatatcgacgtcttttcaggcttaagtatcgttgccctgattttgattccattttgttggctgctgtcgcctgtcaaaagcgaaggcagtgcaggagcacactgacatgaaagttatgagtacgcatcgcctgaatccgctcaacctgatgctggtgttagcgctggcgggctgcagcgtcggccccgactatcaggcacctaagccccagatgccgggcagctatcacgccctggattcgcaggaaaattcgaagccacaaacgtcagcggtggattcacgctggtggcgtaactttaaggacccgcaactcgacagcctgattgcacgcgctatcgaaggtaatctgtccttacaacagacggtattgcggattgccggcgcgcgtgagcaactgtcgcaggcgcagggcggattatttcccagccttaacggttcagccaaggtcacacgacagcaactggggctggaagggctgctgaaagcgaacggtgccgaccagctcgacagcaacgttgccagccagctgaacgggctgatgcaaccggtcaccttgtatcagggcagtttcgacgccagttgggaactggatctgtggggcaaagtgcggcgccaggtggagtcagccaatgcccagcagcaggcggctatagagcagcgcaacgacgcactggtgtcgctcgaagcggaagtggtgcgcgcatggcttcagctgcgcggcgcgcaggcaacggtaaatacgctgcaacaacagattgccgtggccgatcagacctggcagttgacggaaagccagcagcgtaacggcctggcaccggtgaccaatgtggaaaatgcccgcgcgcagttaagcagcctgcaggcgcagttgccgcagtatcaggcacaaacgcgccaggcgatgaacggtctggctgtactgctgggtaaaacgccgggtgcgctggatgccgaactgagtgagccgaaagcgctgcccacattacccgcgtttgtctctgtcggcattccctctacgctggcacgacgtcgtcccgatattcgtcaggcagaagccacacttcatgctcaaaccgccgagattggcatttctgtcgcccagctgttccccagtctgtcgctgaccggtcagttgggtgtccgtaacactgacgtcagctaccttgacgactggagcagccatttctacagcgtggggccgtcgttatccattcccattttccagggtggaagattggtttcaagcgtgaagctggcgcgtgctcagcaggccaacgcggcactcaactatcgtcagacggtgctgacggctctgcaggatgtggaaaatgccctggtcagttaccgtgccgaccagcagcgcgtcaccgcactggatgaaaccactggcgcgctgcaacgcaccttcgatctcgccagtgacagctatcgccagggattatcgactttccttgaggtacttgatgcccagcgccaactggcgcaggcgcaggaacaggctactcaggcgcgcatgcaaagtggactggatcttgtcgccctctacaaagccttaggcggtggttgggaaacctaccagaacgtgcaactgccgcagtacgacgtatttggtccggcaacgcaggtgaattaaccggtccggccgtggccctgtaacgggacacggccggaaaaaaccgtactgatacccgcgatgtattatttatgcgttacatcgtcaaataaaaatcatcaaacttccctgtgcagtcccgtgataacccgcatccgaaatagcctctgctatttatctttacaacgttacccagcaaaaaaatgcgcggcgggtgtgagtgccagacctgccagccctttatcttctgtctgacgcgcccacgtgcttttatgtcagcaacacgccagagaagggcggcataaacaacgtagttagaaaaattaaccccgctattatccgcgagccacgggataaatcccccgttatacgctggctatttcagtggaattcactctggcgacggcaagaaaaacgggcagccgggcaaggcatttaatccaaattcgttgaggatgataaaaatagccggcaagaacgttataaaatctgaggcatgattcatgcagtaagcgtaatcaatgaaatcgtttacattgtgcggggatagccgctatttagtgttaattagtggttaataatctctccacataagcatcctgaatacttcacgagcatttaaaaaacctatcggaattatctgtagcaataaattaatttatttttttatttgaattaggtaatcttgtcgctacagtttaattaaacccccttaatcaaggatattgtgatgagtgacgcatttaaagttctaaacaacattcgcacattacgtgcccaggctcgtgaactgccactgagcgatctggaagaaattcttgagaaattgacggtcgttgtaactgaacgccgtgaagaagctcatgctgaagaacaacagaatcgtgaaaaagaagagaagttatctaaatatcgcgaaatgctgctggctgacggcatcgatcctaatgaattattaggtgccctggagcagggtaaaaaacgcactaagcgtgcgccacgtccggctaaatattcttataccgatgaaaacggtgagaagaaatcatggaccggccagggccgtaccccagcagcaattaaaaaagcgctggatgaaggtaaaagcctggacagtttcctgatcgattaatcgacacaatccttgtaagcggtagccggagacatttatgtctccggctttttttatttaaaaaacccctttgtactctctgactatttctggcatcggcctgttaattaatcgcctgctgggccaggcagaagccgcgccgtcaacgaatgccaccgcggcttgcgtttgcgcggtgctgcgcaggcgaaaatcggcaggggcaataattaaaagcgtcgcgttttcaaggggcattcaggcaatccttgccggaggctggcgtgcgctacgtcacatctggcataatagccgccgtttttccatccactctcttcactaaggtcaatgccgtgttagttagcagcaatatcaccatgcagtttggcagcaagccactgttcgaaaatatctccgtaaaatttggcggcggtaatcgttacggtttaatcggtgcgaacggcagcggaaaatccaccttcatgaagattttgggtggcgatttggtgccatcgggcggcaatgtctcttacgatcccaatgaacgtattggtaaattacgccaggatcagtttgccttcgaagaatatagcgtgctggatacggtaatcatggggcaccatgaattatgggaagtgaagcaggaacgtgaccgtatttattcgttacccgagatgacggaagaggaaggctacaaagtcgctgaccttgaagtcctgtatggtgaaatggatggttacagtgctgaaccgcgtgcgggtgagttattacttggtgtgggtattccggtagagcagcattatggcccgatgagcgaaattgcaccgggctttaaattacgtgttcttctggcacaggcattgttctctaatcctgatattttgctgctggacgaaccgaccaacaacctggatatcgatactattcgttggctggagcaggtgttaaacgaacgcgacagcaccatgattatcatttcgcatgaccgtcacttcctcaatatggtctgtacccacatggccgatttggactacggtgagctgcgtgtttattctggtaattatgatgaatatatgaccgctgccacccaggcgcgcgagcgactgttatcggacaatgccaagaaaaaagcacaaattgccgatctgcaatcctttgtcagccgttttagtgctaacgcctctaaatcgcgccaggcgacatcacgtgccaaacagatggacaaaataaaactggaagaggtcaaagcctccagtcgtcagaacccttttattcgatttgagcaggacaagaaactgttccgtaatgcgctggaagtcgaagcgatcaccaaagggtttgataatggtccgctgtttaaaaatttaaatctgctgctggaagtcggtgaaaaactggcgatattaggggctaacggtattggtaaatccaccctgttaaaaaccctggtcggcgaactgacgccggaaagcggcagcgttaaatggtctgaaaatgccaaaattggttattacgcccaggatcacgcagacgattttgccgacgacctgacggtatttgactggatgagccagtggaaacagcagggcgatgatgagcaggccgtacgtggcatccttggccgtctgttgttttcacaggacgatattaaaaagcccgccaaagtgctgtccgggggtgagaaaggacgcatgctgtttggcaagctgatgatggaaaagcccaatatcctgattatggacgaaccaaccaaccaccttgatatggaatccattgagtcattaaatatggcgctggaaatgtatgaaggaacgttgattttcgtttctcacgaccgtgagttcgtgagttcactggcgacgcgcgtgatagagatgaaagccgatcgtattgtggacttcaccggtaattacgaagattacctgcgcagtcagggcatcgtataaacataacggggtagcgatagctaccccgttatcgtttgggtctgtgcgtcaggtgggattgcctgcgacgatccggcttaacatcctttctttacctgacctgtagccccctccgctttacgcatgaaccctatcaattaacggctcaatcatgatgaccgcacacttcacactcggggtcctgcgataccttcatggtgcgaaactcagcgctcagcgcatcgtacatcagcaaacgtgagcgagcaggagagccgaagtgcgtcagcagcttgagggtttccatcgcctgcattgcacccaccacgcccaccagcggcgccatgacgcccgcttccacacagctcagcacctgagatccaaacaaacggctgatgcagcggtaacagggcgcaccgggttgccagtcaaacacgctgagctgaccttccatacggatcgccgcacccgataccagcggcactttcaactgataacacaaccggttgatttgctcgcgcaccaccacattgtccgtgcagtccacgaccacctgctgctgggcgataagcgccttgagtgcctcatcgtccagttggccgtgcaccggatgcagctgacagtgaggattaatggccgccaggctttcacgggccgattccaccttgttgcgaccaatatccgcatcatgatgcaaaatctgtcgctgcaaattagagagcgataccgtatcaaagtccagtagcgaaagattccctacgcccgccgctgccagatagggcgaggctgcacagcctaaaccgcccagccccacgaccagcacgtggctggcctttaaggcttcctgaccgtcaaagtcaaaaccacgcaacacaatctgtcggttgtagcgcagcatctcgtcgtggctcagttcgggcaacattatccctccagcaacgggttaaagggttcgacgtccacccattcacctgctgcaaccgggccgcgctcgcgttccagtacaataaagcaattggcctgagaaaaagaactgtaaacgtgggagccctgcgcaccggtgctgatcacctctggctcaccctggctattctgacgcagaacaccgcgctgaaaatccagtcgaccgggcgattttttcaacgcggtcgccgtacgtacgcgcaggcgagcgggcagagcggaggcggtttgccccgtcagggtggccagcagcggttgcaccagttgataaaaggtcacgacggcagaaaccggattgccgggaaggccgcagaaccaactgttcgccaggcgaccaaaagcaaaaggtttaccgggtttcatcgccagcttccagaagctaatcacccccagctcttccagcatcgatttggtaaagtcggcttcacccaccgagacgccgccggtgctgatgaccacatcagcctggcgatcggcttcagtaaaggcgctacgcagtgcagtgggatcgtctttaataatgccgagatcgatgacctcgcatcccagcttgtgcaacatcagcgaaatcgcaaagcggttggtatcgtagatctgcccggccgctaagggctggcccacaggttgcagctcgtccccagttgaaaaaatagcgacgcgcagtttacgcaaaacctttaccgtggcgatgcccagcgaagccagcaggggcagttcggccgcgcccaggcgcacgcctgccgccagaacctgatgaccggcacggatatcatcacccgtcagtcgaatattttgtccggcgttgaccggcgcggtgatgacaatattattgtcctgcaggcgggtttcctcctgcatgacgaccgcgtcacaaccggcaggaacaggcgcgcccgtcataattctgatgacgcttcccgctggccactctccgctaaacggcgcgccggcaaaagccttaccggccacccgcaaaggctgtccgctggcaacctccgccagcctgacggcgtaaccgtccatagcggcgttgttaaagggcggtacgtctatcggtgaggtgatggcgcaggctgtgatgcgcccggcggcttctggcagggtcagctcaagcgactctgtgatgggcgtcagctgcgccagcatcttatgttgcgcgtcctcaagggaaatcagtccggcagtaaagctttccattctattcttagcctgtctgttgcaatggctgtctattatggtgacttttcctttcagagtcacatcggcataagccacaacgaaaggttattagcgcaatgtcagtttccgctttacaacctttaacgggctttctatattcaaaaatggtctaaattgacttaaaaccattcaaaatcagtgtttttccttctgatgcaaccacagggtaacgctatggctaaagcagcgatcgccattcatggtggtgcgggggcaataacccgtgcggcgatgagcgcagaaaaagagcaggcataccgtcaggcgctttacgagattgtaacgcatgggcagaacatgctggctcaaggcgcatctgcgctggatacggtgacggaggcggtacgtcggcttgaagagtgcccattattcaacgccggtaaaggtgcggtgtttacgcagcaggggacgcatgagctggatgccagcatcatggatggcaggacgttacaggccggagccgtcgcaggcgtttcccggattcgtaatcccgtactggcggcgcgtgcgctgttagataacagccctcatgtcttgttaacgggggcgggcgctgaagattttgcccgcgcgcaaggccttgaacaggttgaacctgatttcttttctacgcccgaacgctgggagcagctgcagcgcgcgctcggcagcgacaccgcgctgctggatcatgatggcgcggcgcaaagtggcgatccgcttgatccggatcgtaagttcggcacggtgggagccgtcgccctggacaatgagggtaaccttgccgccgccacctcaaccggcggtatgaccaataaacacgtgggccggattggcgactcgccgttacccggtgcaggttgttatgccagcaacgacagcgtggccgtatcctgtaccggcaccggtgaagtgtttattcgcacgctggccgcctacgatgtggcggcacaaatgcgttatggcgggcgctcgttacaacaggccagcgtgaatgttattcacgacagcgtgctggagttgggcggcagcggtgggttgattgcgatcgatcgtgatggcaacgtggcgctgcccttcaacagtgaaggcatgtaccgggctttcgcccgcacagatgaggccgcagaggtggcaatttaccgtgaaagctgaccgcgagaccgcccagaacacgccgcccggcgcaacaccgttaaccgacgatcaggtactggccgtacgcgatctcaacgtgcgttttcagaacgatggcatcgtgacggaggcggtgcgccacctttcactcgacgtttaccggggaaagacactggctctggtgggagagtccggctcgggcaagtccgtgacctcgctggcgttgatgcgcctgattgagcaggccggcggtgaggtgagtggcgagatcatgctgcgccgccgcaacggcgaggtacgggatctgatgcgtctgccacgcggccagatgcgccaggtgcgcggggccgatatggcgatgatctttcaggaacccatgacctcgctgaatccggtgttctcggtgggtgaacagatcgccgaatccattcgtttacatcaaggccaaacccacgccggggcgcaggcagaagcgcggcgcatgcttgatcgggtgcgcatccccgacgcgcaaaacattctggggcgttttcctcaccagctctcaggcggtatgcgtcagcgtgtgatgattgccatggcgctgtcgtgcaaacctgcgctgttgattgctgatgaaccgaccacggcgcttgacgtgacgattcaggcgcagattctgcagctgattcgtgaactgcaaaaagagatgcagatgggggtgatttttatcacccatgatatgggcgtggtggctgaaatggctgaccgcgtgcaggtgatgtatcgcggagaagtggtcgagaatgccgagacggtgcaactgttcagcgcgccgcagcagccttatacccgtgctttacttgccgccgtcccggcgctgggggcgatgcggggccagccgctgcctgcgaagtttcccctgattgacagtgatgaaaagccggacgagccgcaaaataccgtacgccatgaccagccaccgattttacaggtgcgtaatttggtcacccgtttcgatatccgctcaggtttattgaatcgggtgacaaggcgggtacacgcggtcgaaaatatcagttttgacctctatgcgggcgaaaccctggcgctggtgggggaatccggatgcggtaaatccaccaccggacgctccctgttgaagctggttgccagccagggcggcagcatcacctttaacggtcaacgtatcaacgatctgtcaggccccgcgctggcgcatctgcggcgcgatattcagtttatttttcaggacccctatgcgtcgctggacccgcgcctgaccgtcggcttctcgattatggagccgttactggtgcacaaggtcatgccgcgccgtgaggcggaacagcgcgtcgcgtggctgctggagaaagtgggattattaccggagcacgcaaggcgctatccccatgaattttccggcggtcagcgtcaacgtatttgcattgcacgggcgctggcgctcaaccccaaagtcgtgattgccgatgaatcggtttctgcgctggatgtctccattcaggcgcagatcatcaacctgatgctcgatttacagcgcgagtttggcatcgcctttctgtttatttcccatgatatggcggtcgttgaacgcatcagtcaccgtgtggcggtgatgtatctgggacaaatcgtcgagatggggccgcgccaggcggtgtttgaacatccgcagcatccctatacccaaaagcttatggccgcggtgccgattgccgatcccgcgcaccgacagcgcgagcgtagtttattagtcgatgagattcccagcccaattcgttcattgggcgatgaacccgaaacggtttcgctcagggaagtggcccccggccattttgtggcgcgtcacgccctgagcgcgagctgaataattaagcggtcgctgcggcgacaaatcagacagggattacaaggagaagacaatgcagataacgatgcgtaaagggttactggctgcgggcgtactgagcagcgcaatggcgttacccgcgtgggcagcacaggatgcagtgattgccgttgcctctaatttcaccacgcttgatccctacgatgccaatgacaccttgtcacaggcggtagcgaaatccttttatcaggggctgttcggcttcgataaagatatgaagcgcatcaatgtgctggccgacagctaccaggtgagcgaagacggcctgatctatacgattaagctgcattcaggcgtgaaatttcaggacggcaccgactttaatgccgaggcggttaaagccaacctcgatcgcgccagcaatcctgataatcatctaaaacgctataacctgttcaaatacatcgccagcactgaagctgtcgatcctacgacggtgaaaatcacactcaagcagcctttttcagcctttattaacaacctggcgcaccctgctgcggtgatgatctcgcctgcagcgctgaaaaaatatggcaaggacattggtttccatccggtaggaaccgggccgtttgagcttgtgacctggaaccagaccgattttgttaaggtgaaaaaatgggatggctactggaaaaaaggctatccaaaactcgacagcatcacctggcgtccggtggtggataacaatacccgtgcggctatgttgcaaacgggcgaggcgaattttgcctttcctgtgccttatgagcaggccaaactgctggagaaaaacagcaagcttgatgttgtcaccacgccatcgatcatgcagcgttatatcagcctgaatgtgacgcaaaaaccgtttgataaccccaaggtgcgagaagcgctggaatacgcgattaaccgtcaggcattagttaaagtcgcctttgccggttatgccactccggccaccggggtggtaccgccgtcaattgagtacgcacaaacctatccacccattccttacgatcccgccaaagcgaaagccttgctgaaagaagcgggctatccgaacgggttcgacaccacgctctggtcatctcacaatcacagtacggcacagaaagtcctgcagtttgttcagcagcagctggcgcaggtgggcgttaaggtgaaagtgacggcgatggatgcgggacagcgtgcggcggaagtggaaggcaaaagtcagaaagagagcggtgtacgcatgttttataccggctggtcagcctccacaggagaagctgactgggcattaacgccgctgtttgccacggctgcctggccaccggcgatctttaatacggccttctacagcaaccctaaagtggataaagatttagcggatgcgctgaaaaccaccgacagcaagcaaaaagccgaacgctataaagatgcgcaggatattatctggaacgatcatccgtggattccactggtggtggagcagctggtttcagcccacagcaaaaacctgagtggcttttatgtgatgccggatacgtcattcagttttgacgatgccgagctgaagtaatccggcgcgcccgttcaggttgtcgacaactgggcgctgcccagggttgaaacctgagcgggttttttgatgcccgctgtttcagtgcgtgctgaagctgcgctgacgataccgggcaggtcagccacgacggctggctgctgtgtaggatgtgacatgtttaactattttcttaaacgactgttgggactgattcccaccctgcttatcgtggcggtgctggtgtttatgtttgtgcacctgctgccgggcgatccggcgcgcctgattgcgggtcaggacgcggatgccacggttgtggcgctggtgcgacaggaactgggactggatcagccgctgccgctgcagttctggcattttatcgtgaatgccctgcagggggattttggtcagtcgctggtgtcaagacggccggtatcagcggagattgccgcgcgttttatgccgaccctgtggctgacattagtcagcatggtatgggcggtgattctggggatggcgattggcattgtttctgcggtatggcgcaatcgctggccggatcgcctgggaatgacgctggccgtgtcgggcatttcctttccggcgtttgccttgggcatgttgctgatgcaggtgttttcggtgcagttgggctggttgcccacggtgggtgccgatagctggcagcactatattttgccgtctgttaccctgggtgccgcggtcgccgcggtgatggcgcgctttacccgcgcctcgtttgttgaggtgatgcaggaagattacatgcgcaccgcgcgagccaaaggagtgcgtgagtcgcgtgtggtgattaaacacgggttacgtaatgccatgattccggttgtcaccatgatgggcctgcagtttggtttcctgcttggcggctcgattgtggtcgaggtggtattcaactggccggggctgggtcgtctgctggtggattcggtgcagatgcgcgactatcccgttattcaggcggaggtactgctgttttcgctggagtttatcctgattaacctgtttgtcgatatgttatatgccgtcattaacccggcgattcgctttaaggacacctgatgaaaaactggcgacgggaagcggcacttaaaacgatgccgctgttaaacggcaaccgggtaagaacaccgtggcgggaattctggcggcgttttcgccatcaacccgtggcattgctggctggcgtcttcgtgctggtgctgattgtgttggcctttacggctccggctattgcgccgttcgacgcagaaaattactttgactatgaccgcctgaacgacggcccttcgctgatgcactggtttggggtggattcactggggcgcgatatctttagtcgtgtgttggtgggcacccgaatttcgctgattgccggttttgtttccgtggcgataggcgcgtttattggcaccctggcgggcctgctggcgggctactacgaaggctggtgggacaggataaccatgcgcgtatgcgatgtgctgtttgccttccccggtattctgctcgccattgctgtggtggccattatgggcaccggtatcagcaatgtgattatcgccgtggcaatcttcagcattccggcctttgcccgtctggtgcgcggcaatacattggtgttgaaacatcaaacctatatcgagtccgcacgaagcattggcgcctccgactggacgatcattctgcgccacctgttacccggcacggtatcgtccattgtggtgtatttcaccatgcgcatcggcacctcgattatcacggcggcgagcctgtcgtttttggggctgggcgcgcagccgccgacacccgagtggggcgcgatgctgaacgaagcgcgagccgatatggtgatcgcccctcacgtggcggtttttccggcgctggcgatttttttcactgttttagcgtttaatttgcttggtgacgggctacgtgacgcacttgatcctaaactcaagacatgaaaccttttgattacgaacaagacttcagcaccatcgattttcgcaagcagcctgaacgttatcaggtgggccgcggggagcagggcgtgctgatggtccagccctataaagacgaaatcttaccgcactggcgttttcgcaccgttgaggtggcgaaagcgtctgcagaagaaatcatgacgttgttcgaagcctatcgccagcaggatgactttgtggggatggacatggcgcgcaaatttatccagatgggttatacccgcgcccgtcgctacagcaaccacaaaggcggccgtaaatacgctgcggatggcaaagagctgccccgaggcagggacgaagaaaaggccgctgcggcggccattttcaaagcgtactgggacaggttacgtgcagacgatgactatctggcgcgcaagaaagcgcaccagcagaagtacggttaagcgcggctggcccacaaatcgtattcgtccgcgtgttcaaccttcacgcgcaggacgtcgcccggcttaacattactttcaccattcaggtagacggcgccgtcgatttcaggcgcatctgccatgctacgaccaatcgcgccttcttcatccacttcatcaatgatgaccataatttcacgtcccactttttcctgcaggcgttcggcagagatctgctgctgcaactgcataaagcggtcataacgtgcttgcttaacggcttcatcgaccggatcgggcagttggttagccgttgcgccctcaaccgggctgtactggaagcaaccaacgcgatccagacgggcttctttaataaagtccaaaagcatctggaagtcttcttcggtttcaccggggaagccgacgataaaggttgagcgcagcgttaattcaggacaaatttcacgccagcgcttaatgcgctccagcgtacgttctaccgcgccagggcgtttcatcagcttcaggatgcgcgggctggcatgctgtaacgggatatccagatacggcagaattttgccttccgccatcagtggaatgacgtcatcaacgtgcggataagggtaaacatagtgcaggcgaacccaaacgccgagtttcgctaactgctcacacaggctcaccatgctggtcttaaccggcgcaccgttccagaagcccgtacggtgtttcacatccaccccataggcagaggtatcctgcgaaatcaccagcagttctttgacgccggcttcaaccaggcgcttcgcttcatccagcacttcaccaatggcccggctgtcgagatcgccacgcattgaagggatgatgcagaaggtgcagcgatgattacagccttcagaaattttcaggtaggcgtaatggcgcggcgtcagcttcacgccctgttccggcaccaggctcagaaacgggttatgctgcggttttggcacgtagcgatggacatgcgacagcacttgttcatagctgtgtgggccggtgatctccagcacctttggatgcacctcacgaatctggtcgactttagcgcccagacagccggtcacaatgaccttgccgttttcgttcagggcttcaccgatcgcttccagagattcctgtacggcgctgtcgataaatccgcaggtgttgacgataacgatttcagcatcgtcatagcgtggcaccacctcatagccctcggtgcgcagttccgtcaggatgcgctcggagtcgacaaggttttttgggcagccaagcgagacaaatcctacgcgcggcggcagtgtattcgtagtggacataaggtggtttccggttcagcacagcaatggcgcgcgattttacctgtgttgtgatgaaaattgtagcgttatctgtaagggattggttaagcgtaaagtaacgcaaaaaccggtaaaggtcaggcgcggttgccgttgacgaaacggcagagcaggcgggcggggggaaagcactaactcaccgttctgtaaaagaaattccaataaacacctaataactggagggaataaatatttaacaatcctgactttactggcgggcttttgcccagattctcggttgatatttgcttgttttcattaataatgaatcgcttaacaagtactgaaggcaccgtttcttcagatcatgacgtggataatgtgagagcgaaataatgaaagagatcatcaacgggtttctgagttttcagcagacagtctttcccgaaagaaaagcgctttttaaaagtctggcatcaaaccagaatccaaaagcgctgtttatctcttgctcagacagccgtctggtgccggaactggtgacgcagcaggaacctgggcagctgttcgttatccgcaatgcgggcaacattgtgccctcttttggcccggagccgggcggtgtgtcagcgaccattgagtacgcggtcatggcgctgggcgtttctgacatcatcatctgtggtcactccaactgtggcgcaatgaacgccatcgcctcctgtgcctgcatggattcgatgccagccgttgagcactggctgcgttatgccgatgcggcaaaagcggtggttgagcagcgtgaatacgattcgcctgagaaaaaactcaacgaaatggtgcaggaaaacgtgattgcccagctaaacaacatgaaaactcacccgtcggtatcggtcgggttacgtcagggtaaactgcggctgcacggctgggtgtacgatattgaaagcggcacgattctggctctgacgccaggcggtaaagagtttatctcactggcggaaaacccggacacctgtttcgaataaccgcttccgcccgctatcttactgcgggcggtctcttctcttcacgatcctttttcggtcggcttctcccgcgcctgccattgcgcatcctgttgccaacaccttgtttaatcttttgtaaatcctcaacagcatccccgacccgctgactacgcttaacaacactgcaccctgtgaggagaaggctatgtcccgtgtttcgatcccgctgttattcagtggcgcgctactcttttccagcccgctgtgggctgatgaactcaaggttgaggtgctccaggataagctggatcatccctggtcagtggcgtttttgccggataatcaaaccctgctgatcaccgaacgatccggtcagctgcgcagctggcggccagacagcggcttgtccgaaccgattcagggcgtgccgaaggtctgggcgcagcgtcagagcggactgctggacgtggtgctggcacccgattttgcgcagagccgccgcgtctggctcagctataccgaagcggacagcaacggcaaggccggcgctgtggtgggctacggcaaactcagtaacgacaatcgccagttaaccgattttcatgcggtaattcagcaaacgccgcgcctctcaagcggtaacaacatcgggacccgactggcctttgatcgtcagggctttttatggattgcctttggcgacaactttgtcagcagcgccgcacaggacctcgataaacttcagggcaaactgctgcgcctgaacgcggacggcagcgtgccaaaagataatcctttcgttgacaggcagggcgcgcggccagaaatctgggcctatggcctgcgcaatccgcaaggtctggcgctgaatccctggacgcagacgatgtgggaaagtgaacacggtccgcgcggtggagatgaggtgaatatcatccagaagggcaaaaactatggctggccgctggccacctacggtattgattacaacggcagtaaggtcccggaatctaaaggcacgcacgttgagggcacggaacagcccgcgttttactggaaagtctcaccggcgatcagtggtatggcgttttataacagcgcgcgtttcccgcagtggaaaaactccctgtttatcggggcgctgaaagagaagaacctgattcggttgcacattaacggcgagaaagtggtggaagagcaacgcttactggacgggcgaaatgaacgcatccgcgatgtccgccaggggccagatggctatctttatgtcttaacagatgaagccgagggtaaattgctgaaggtagggttgaagcaggacgccagcgcgtcccgcggttaaattagcggacccagtggcagacctgccagccgcgtttttcggcttcctggcgcagcggctcggccgggtttatcacgtgtgcataatcggcctgcgccagcatgggcaggtcattcatggagtcactgtaggcccaggtatgtgcgtactgttccgcagggcgttcagccttccattcttccacccgtttcactttgccctgctgaaacgtcatggtgccataggtattgccgctgtagcgctcatccaccacttccacgccaatagccagcgcgccgcaggcaccaagctggctggcaattggattcaccagatgctcgccgctggcggaaatgacgataattctgtctccgcgcgcctgatgccagtcgagacgcgcccgcgcttcaggaaagacgcgcggcataatatcgcggtgaataaagcgccgaacccatccttccaccgtcatcgttgccatcccggctaaaggggagagggttttacgcatgtactcgtcaatggacagcgttccggcgtaatactggcgcattaattcctgttcttcatcaagcaggtcactggaggcgaagccttgtgagaccagccagcgcagccacaggccggtactgtcctcgctaatcagcgtttcatccagatcaaacagggctaaatccatagggggttctcctcgattgaataaagtcaggttaacccagttttgtgacggccttaactttttgattaaaaaatcagaatttagcgcatttttatgtgcgacattcgtgagggaaaatggcaggcgcgcggcgctcagaccagggttaatctactaaaatctataaaactttacgattaagcggtttttttcattgacgccagcgggtagcgttctcacagaaggtgttaagcctttgactttcgttttactaaggacaatccggccaagcccatgacaaatacttgcttttcatctcccctgcggcgcatcgctgcgacctcgttgttactcatcgcgccgatggctgtttttgctgaacaggcacccgccgcgcctcaaattgatgccagggcctggatcttaattgactacgccagcggtaaagttctgacagagtcgaatgccgatcagcggctcgatcctgccagcctgacaaaaatgatgaccagctatgtggttgggcaggcaatcaaatccggcaaaattaaacccgatgatatggtgacggtggggcaggatgcctgggctaccggcaatcccaaactgcgcggttcttcgctgatgtttcttaagcccggtgaccgcattccggtgcatgagctgaacaaaggcattgtgatccagtccgggaacgatgcctgcatcgcactcgcggactatgtggctggcagtcaggattcctttattggtctgatgaataactatgtcaacgcgcttggcctgaaaaacacccattttatgacggtgcatggcctggatgccgaggggcagtacagtaccgcgcgcgacatggcgctgattggtcaggcgttgattcgcgatgtgccggaagagtatgccctgaacaaggaaaaagagtttacctttaacaacatccgtcagataaaccgtaaccgtctgctctggagcagcaatctgaaggtggacggtatcaaaaccggtcacacctcaggtgccggtaataatctggtggcctccgccaccgaaggcgatatgcggctgatctcggttgttttgggaaccgccagcgatgccattcgcttccgcgagagtgaaaaattactgacgtggggttttcgcttttttgaaaccgtgaccccaattaaagcggatgccccttttgcccagcagcgcgtctggtttggcgaacagaatcaggtcaaccttggcgtggaaaaagacgcggcactgaccattcctaaagggcagatgaaaaacctgaaagccagctacagcctgacatcgccgcagctagaggcgccgttgaagaaaaaccaggtggtcggcaccattgattttcaactggacggcaaaacgattgaacagcgtccgctggtggtgctgcaggatgtgccggaaggcggcttcttcaaccgtatcattgattttgtgatgatgaagtttaacggctggttcgggaagtggttcagctaacgcaggtgatggttacgcccacctgctcattgcgcatcagtcgtcactcgataaacacagggcatttcgcctcatccgatatgcggtggccgccatgcagaggcatcttgaatctggacataagaaactgccattgatgatatctgtgctgttctgtaccggtaaatccgtattccacccgatggctgggtgagttttacggacctgctctggcagcaaaacgctacagcagtgctttcccgctgattgttgttataccgtcattccgggtgatgcaatcgcagaacactgcagtagggctgcactgacatggtcgtaaaaacatcttcatcagcgggacctggcagaacgggttgaccggctggcgcctgttgcgctggccgggcatctgtcttcatcgcaggtgatatcgccagtacatcctatagtgcagccagtcggaacatccgacgctgcattttaaatctccatgtcttctgtttcatacccggatgaaagtccgccggtcagattatggaaagacgttcgacgtgctcagtacgagccctgataaacggccagtacagcaccattgacaaaatcgctaagctcgcgcgatcacggcgaaaatcttacaaccacatttcagggccctgtcctttttttgcggcaagtctacattaatgcagttgatgcttatgaattggttatgttgcgtagagcaacggctatacatgcaaccgcctgcacctgtataaatcatcacgctggaaataacccactgtatgaatgaaggccatattaagttagtaataaaatacaaacaattatatgcaaattgcttatcaagtgcgtatgcatgaataatataaatttaaatgataatttattgatgttgatcaatatttatgctcagtttaattgtttttaactaaaaatagtgattgctatataaggtgttatatcgttgccgccaacaaactgtgttagcaaaagtgagtaaataactacctgttccctgcctgcgatagctatttctcacatagcagcaacaaatttctgcaattccagataaagtataaccatcacgtcactcaatcattcgaacgtcatattgacattctgataacgtagccattaacgcctgtttttcgctcggtactcaaagcaacatttttctttcacttatattatatttaataaacaaaaatattttatattggtaacaggtgatattggttttaaagagaggatttgggatgttaatcacgaaataaagaaaagtaggttctttcactttattatacaaaaaaacttaactagcatttaaaactgtaatagataccactaacagcaacgcatataaatcgcagataatatcctgaggcagattttatatggacaaaaatatgaaaggaaactacggtcagcatgttttccggcaggataatcttaaggagatgcatcgccttgagttggtttcaaaaacctatgattttttaacaaaaaagcagctttcaaaaataactacccgtccgggaatgcgatgcctcgatataggttcaggaagcgggagtatagttaaatggatggccgaacaaccaaacgttagcgaggttgtcgctgttgatcatttggttgatttacttgaagagaaatttattctctctgataaagtaaaagtaatccagcatgatattaacgaggtcatggatatcgaaaaatttgatatcattaatgtcaggtttgtattgatgcatttgcgcgagcggaagcgaattttaaaagaaatatccgaattgttaaagcccggaggctggctcgttgtttctgatattgtcgcccctgcagaagatccggaagagccagcgttccatcaacttatgtccgtaatgtggagagtcttaatcgactcaattggaaccgatgttaactggtccaaaagccttaagtctcaatttaaatcgtcaggaatagtcaatattcaagaagaagtattctttcccccgataagtcgcaacacgccaatgagtgagttctggtatttaacattaaatgatttgagaaaccatatccttcagggaagcagtctggaagagcgtgtttttgatgaggttttaactaagttaaaaaatggagagttcatcacgctctcacccggaatgctcacctgtattggccaacgtcgtttctagtttaaatactgaatcatggctttgcattttagataaatttaatttgtctgcttaacttaatggaataataagcaatgaaaataacagatgaagagatgttgttccccagcgatatcccatatgacaaagtcccgccctggagagtcaaggttgttgaatatgttactccaacgacccgagttcagcgcaaagaacttattaagcaattcaactggtcggtaccaaatctgcctgctgagtatgtgtatgtgaatatgtgtaccgattcgggtacgaatgcgatgagcgatcgccagtggtctgccatgatgttggcggatgagtcgtatttcaactcaaagagctggtatcctctgcaggatgtattgcaaaaatttacaggtatggattttgttatgccctgccatcagggacgctctggtgaggcaataatttacgaggcctttgtgaaaaaaggcgatcttgtaccctcaaactgtcatttcacaactacccgcgcccattgctattaccaggaagccgagccggtagatttaacctgccctgaatatttcgatgagaataattcttcatggtttaaaggtaatatcgatacagaaaaaatgaaagccctttttattgagcacggtgagcgcattggcctggttgagcttgtggtgccaaataacttgtgtgcagggcaacctgtctcgatgcaaaatataagagaagtcagggatatcatcgataagtacaaaaaaagagatgttttgctatgtcttgactctgcccgaatatcagaaaatgcctggataataaagaaacatgagcagggttttgggcataaaagctgtaaggaaattgtacgtgaaatgatgtcttacgccgatatcgcccatatgagcgcgaagaaagcagggctcgttaatacggggggattcatctcattaagaaataagacggactgtcaacgtttgcagccaaagctcatacgtattgatgggttcatgacttatggcggcatggcaggacgcgatctcgaagccctggctgttgggctggtagaaggcgtcaatgattattatctggaggataaacaaaggcagtgtgacctgtttgccaatgcgtgcaggaccagaggtgtcgcgacgtataatccagcatgtacgctgggcgtatggataatggcggagcattgcctgccgcatatacgaaaagaaaatgggccgggtacggcattgtgtgtacaggcctttattgaaggcggtgtcggctttacctctatggactcgctgcatcgggggcgtgaagacagtaaagatccgactaatacacaaaaaatacagctggcgccttatgaattaattcgctgcgcctttcccagaagggtttataccgatgcgcattatgagtggtgcgctgaatcactctacaaagcgatgtgctggggagagaaaattccgccctatgttcgtcaaaaaatgagtgatatcagacccgctttagatcctaaggatatcggtctacgggctttcttcgatgagtatgaacccctgtttgatcatccttaatatcccttttttaatcggagaataaaatgagaataagtgcgcaagacatgctgctccagaccgatttaccttttgataaggctcctccttacagaatcaaaacgattgaatattctatccctaccaccagagaaaaaagaaaagaaatcatgcagcagtacgggtattcagggagattattacctgcaaaatatgtgttcatcaatatggtgacagattccggaacaggtgcgttgagcgacaggcaatgggcagcaatgatggagggtgatgaatcttattttaactgcaggagctatgagcatttagaagaggtatgccagcgctttacgggcatgccctatatcatcccttctcaccaggggcgttcagcagaagcgccaatttatgaaatttttgtcaatcccggtgataaggtgccatcgaacactcatttcaccactaccagcgcgtggacatttcagcgaggtgatgaacctgtcgattttctctgccccgactaccttgaccggaaaaataatggctggttcaaaggtaatatggatcttgaaaagtttgaacagtactttattgaacatgctgaaaaaatacctctggtggaactggttgtccctaataatcttaatggtgggcaatgtgtctcaatggataatattaaaaaggtgcgtaaaatcattgataaatataataaaagagacacacagttatatcttgatatcgccaggatttcggagaatgcatggataataaaacagcatgaagagggttacagcgacaggagttgtctggatattgttaacgagatgctttcctatgctgatggctgccatatgagtgcaaaaaaagggggcctggttaacatgggtgggttcattgccttaagaaacaaatattactggcaaaaaatgcaccctaaaactattcgtactgacggttatattacctatggtgggcttgccgggcgtgaccttgaatgtcttgcagtcgggttgcttgaaggggttaacgatcattatctccaggatcgacagcgccaggtcgattactttgccaatgcctgtaaaaaaagaggtattcatattctggaacccgccagctgctttgcggtatatattgacgctggtcgctgccttcctcatcttgattatacgcagggaccagcaacgtgtttatctgcccaggcttttattgagggaggatttgcttcaacggctatggattctctgcaacgaggtcgcattgatgtcagtaaacccatggatgcggcaagtcggctcaaagcaccctacgaattaattcgatgtgcaattccacgccgaacctatttcgaaccacattatgagtgggcagcagaatgcattcagcgtgctatcgaatggggtgacaaacttccggcattcaaacctataaaggatgatcgtccgccacttgaaatgagcgaaattggattgcacacttttttcgacgattatgaacctgtatggcctctcccctgatgtagcctgataatctgtagactcacttttcattgatcatattctgagggtttttattatgcattggctttacaaaaatatcaaagataaggctataagagagagggaaaaagtcttcattgaatccagtaaatgcatccggctgccctgctcagagattagcagcgatgaggttaaattactgctaaagaataattcgtataaaggaaaaggtacaacccgcaagcttattgaatactttcatatgccggtagactggcatgtggaaaatatggatgaatcgccattatacactgaactgctgaaaatagtttatccgaaattaatgatgacaagggctgatattgaagagtgtatcactaatattatacgtcagcgcggttctggcctgttatcagaaaagaaatatgggtttgctattatcaggaatgaaataataatgctgatggtcgatttttttcatcttaaactcttcgccaggttaccatcacctgaagagcgtgattttcttagtcaaaatgttatctcttttaaagaaagtatttcatttattaaaatgcctgatgaaaagctcagagcaaaggtcctcagacatatcactgctcaattttcacctgatattatcactaccctgcgcggcaaagtatctgaggatgtgaccaatgaacaggtcgccaaaatattaatgggggcgttttttcataccggggtgctacagattgcagagtttgttgcacataccattgtgagtcttgctcaaaaccccgttgagcagcaaaagatacgacggcgaaactttgacaaagcatcaatgaaaaatgtattgaacgaatctctgcggttgtatcctctcttcggcgtgactaacagagtcacagaagaaaaacagtttatggtgaacggattaacgattgataaagggactaatttaatttttgacttcgttaagctacatcaagtgggatttactgatcctgaaagatttgatccggacaggtggaataacataagtacctctgacaattgctatataccttttggcgttggcaaacgcatgtgccctgcgaaaacattttctcttactgttacggctgtactaactgaacacctgttaagaaaatattcatttatcagttctatccatcatgacaggcctatgactggcggcggtcgggtctttttttcgaggctgaataacgaagtaaagccaacgagtaaaatgatccatgcacttgcacttttttatattgatttgacagaatcttggtttcagagacgggcagctttatcagttataactaacagccgaaagtttaaagagaatatagacaggatttgagactcaactgaacgatttcacacgctcaacttttttcccctataaatacgaatattatgggcagttacaaacacgctaaaaatggtgtctttttaatggaaaaatggcatttaccggacacttaacgtgaggtttggcgtagcatattttcggtttcacaggcagacctctgttctttatgccgttgattaaattatacggttgaaccgtcctgaatagcgttgacacggtttccctgggttttcagcagaatgtgatgcgtttattaaacgtatataacgggacgactctcggtcctttaaactgactgttgttgaggaggttgaaaaaggcggaatgacatacactcaggctcaggaacgctatggtcttcaggattgctccaccgtcctgaactggctgcttaaatatgaccaacctgactggcactcttcaaagcagcgtagcgcccgtggaggaatcggtaaaatctgcaacggtcagcgcccccacctgtcgctgaaatacaaagcgcctgatgcagtgcatcaggcgcttcaaaaagcataacgtgtcaacctatgccggggccagtcaaccttgtgtccagcctttacgtatcggtaaagcgaacagcgcccgatagaacgggttaatgatattaagcagacgttcgccatacagctgccaggcaaggtgcgacgccaggcaactcagcattcccaccagaaaaccgcccagcatatccattggccagtgcacgccaagataaacacgcgaccaggcaatcgcagtggcgaccaccatcaggataatgcccgaccagagtcggtgccagaacaggaaagccagcgcaaaggtgaaaatcgtggtgccgtgatcgctgggatacgagtcgtcggcagcgtgtgccagaaactgatggccgaagttgatcgcaaacggacgcggatgcgggaacagttgtcccacgcaccaggaaatggctaatgcatagagcagcgcgatgccggtttttaacaccagcactcgctgtgacgccacctgatcgcgcggtccccacagccacaatgccacaatcagcagcgggacaatggcaatgacgtctttggctatgaagagggcaagctgcaataaccagtgaggtgagtctgaggtagcgttaatcgccataaatagtgtgcggttcaattcttccattacgtggtcggttcctcttactgatgttcagattctctcaatcccggaaaaagggcttaagccaacgggcaaaagcagattgagtctgtcgcatctgctagcacatgttgctaacaaaataagctgcctatcctgcgtgcagacgggcagagagtccatcactaggttcttaatctgcactaaggttgcaaaatggtttaagtttggtgaagttttaatgttgaagtggggcgggcaggatgcaaggcataaaaaaacccgctgggaaaaagaccagcgggctccacaatttggggatttcaaagaaaagcagtggcacttattcagactgtggtcggtaaaaaaagttctggacgtcagtaaaaaaattttataaggacagtaacggccagataataacgattaatgtgcccgccagcgtcagcaaaacgttcgcgatggcgtaggtgccggcatagcccagcgcagggatattactgcgcgccgtatcgctgataatctccatagccggtgcgcaggtgcgtgcacccataatggccccgaaaagcagcgctcggttcatgcgtaaaacataagcgccaaacaggtagcaaatcactaccggtaacaggctgaccaacagaccgcacaagagcatcagcgcgccgttagccgatatgccatggtcgataccgctcccggcactcaggccaacgcctgccataaacaccatcagcccaaactctttaaccatcgtcagcgcaccttgcggaatataaccaaaggtgggatggttagcgcgcaggaagcccagcataatgccggcaaacagtaaccctgcggcattaccgatgccaaaactgaagttgctgaattgaaacgtaatcaacccgaccatcaggccgatgataaaaaaggcacagaatgccagcaggtcggttatctggctgtgaatcgcaataaagccaatgcgatccgccacactttttacccgccgtgcctcaccactgacctgcaacacatcgcctttattgagcatgatattgtcgtcaattggcatctcaatctggctgcgaatcacgcggtttaaaaagcagccgtgatcggtaagattgagtttgctcagccgcttgtttacggcgttgtggttttttaccacaatctcttcggtcacaatccgcatatccagcaaatcgcggtcaaagacttcttttccgttacggaagctggcatccagtcgcgcgtgcgcatccggatagcccaccagcgaaatatcatcccccagttgcagcaccgcatcgccatccggactggcgaggatgccattacggcggatacgctcgatatagcagcctgtctggcgatagatcccgagttcgcgtaaattcttaccgccgctccatgccaccagctccggccccacacgataagcacgaatcaccggcagaaacactttgcgctggctgtctgcgtcaaggccgcgctcacgtgcaatctgttgtgcgctggtgggtaagtcctgatgttgcagacgggggagatagcgagcgccaaaaatcaggctgactaaccctatcaggtaggtaacggcatagcccagactgagttgatcctgcatcatgctgagctgtttaggatcgctgatgctctggcgcaacgtatcacctgcaccgaccagcaccggcgtagaggtcatggaaccggccagaaggcccgcggtcagcccgatatcccagccaaagaatttgccaaatcccagggccaacagcagggcgctgaccaccatcacgatggcgagcatgaaatagtttttgccgtcccgaaagaaaatagaaaaaaagttgggacccgcttcaatacccacacaaaaaataaacaacataaagcccaggcttagggcatccgtattcatcgagaagtgctgctggcctaataataacgaaaccactaatacgccaatggaattgccgagttgcaccgagccaaaacgtaatttccccagacaaagtcccagagccagcacgaaaaataataacagaatgtcattacctcttaacaattctgcgatgttaacattcaacattttaacttcttgtttacttgtaacctattgaagagaggcttgtttttcgctatcttgagcaagccgtaagattaccttcagcgatcatcgatttctgaaaaggtaacgaggccaatattctaatcagaaaaaccattctcagccattggcgactttcattcgtatggcaaacggctgtttatttttatttccaccgggctcagcaaggtcacagacgatgttttggcgagtttttaatgagtggggagttatgccgcagcgttattatttctgggcaacctgcctgtcaggtggcgtgttttattgtttagtctttatgtttacccaggatttccggctgttagataagcaggtgttacacagccagcctgaactgctgctttttttgctacctggtgcattaatggcgctgatgcagcaagaggcaccgctaaaaagcacgctgattatggcgtttaccgggacgctactggccgcgctgttattgcatggcgttttcgctgagcctacccgatgggattatattgctatctggagcctgagtggcatgttttgggcgggatgcggtgcactactcgtgcggttgctgcgactgatcgctgcgtccagacgttaaatgcttagacggggttatgtactgcccgttatcctgttgagtcaggtcagccatttcattaaggcgcggctggcattacgccagcgcgcacattcaggttaccgcctctgttgctcaggcaacaaatcccagattctcttttgtccacgccgcaaactcggtgtagccaccgatatgctgatcgtccaggaaaatctgcggtacggtgctgaccggtttgcccgcactggcttcgagatcggctttggtgatgccttccgcctgaatatcaacatactggtagttgaaatcatcacgatcggcctgcagtttatccgccagttctttggcgcgaacgcagtaagggcagccgggacgaccaaaaataacagcaatcattgagaactccttgcgaggtacgttgtgtgatgatgatcacacgacaaagtcaggaaagccggtaatgatgcccgctcgtcgcgcttaaagaaagcaggatttacctgttagtctgatgcctgcatcctatgaatccacaaagtgagtcagggcgcgagctgaaaccactgatgtgcaatttaagggatgttatccataattgagagtcaattagccttgaggcaggagaaagctatgcggaacatcgcaacgttgcctaagaccatactggcaatggaagcgctgggcggtttgcttattgtcggcgcgctggtcgtggttaaccgttggttacctggcctgcccaacggtgccggaagtaagcacttagcgaccgcgctgtttatcatcggcattatgctgatgttacctgccgcctggctgttgatgtggcgctgtgccaaagcactggcgccgcagttgttcaaccaatctgaaaaaaaagataattagctggagattttatgacaccgactatcgatttactgtgcagccaccgttcaatccgttctttcactgaccagaaggtgagtactgaacagcgtgacgcgattattgctgcggcgcaatcggcgtccacatccagctttttgcagtgctcatccattgtacgcgtgaccgatccggcgttacgcgatcaactggtcaccctgacgggcggccagacgtgggtggccgatgcggcggaattttgggtattttgcgcggactttaatcgtcatctgcaaatctgcccggatgcccagttaggccgggcagaacagctgctgctcggctgtgtggatacagcactgatggcgcagaatgccatggtagcagcagaatccctggggctgggcggcgtatttattggtggtattcgtaacaacatcgcccaggtaaccgagctgctggggctgccaaagtttgtgctgccgctgtttggtttctgcctgggctatcctgaatccgtgccggatgtgaaaccacgtattccgcagtcgatgctggtacatgaaaatcgttatcaacctgtggacccggctgtgctggctgattacgatagccgtacggcgatctactatgaacaacgcgacagcaatcagcgtagcgaaacctggagccagttgattcagcgcctgatcatcaaagaaacccgcccgtttatgctggattacctgcatcagcagggctgggcaacacgctaatttaacgcaaggattttgatggatgaaaatggccattctgtcgcgcgatggaacgctttattcctgtcgccgtttacgtgacgtcgccgaacagcgcggtcattttgtgcagatcattgatcctctctcgtgttatatgaacattaaccccgcctcgcccggtattcactaccgcggcgagctgttggggcatttcgatgccgttattccgcgcattggcaccggtattaccttttatggcaccgcggtgttacgccagttcgaaatgtgcggcagttatccgttaaacgaatccgccgctgtgacccgcgcgcgcgacaaactgcgttccctgcaactgctggcccgggacgggatagatatgccggtaacgggttttgcctcttctccggatgatactcaggacctgatcgccatggtgggcggtgcgccgctggtggtgaaactggtcgagggaacccagggcattggcgtcgtgctggccgagacgcgccaggcggcagaaagcgtcattgatgcctttcgcgggcttaatgcacatattttagtgcaggagtttatccaggaagcgcgtgggcgcgatgtgcgttgcctggtgatcggcgatcgtgtcgtggcagccattgaacgtcaggcgaaagaaggggatttccgttcgaatttacatcgaggcggtaccgcctgtacggttgacatcagcgagcaggaacgtgagatggcggtaaaagctgccgctgtactggggctggatgtggctggcgtggatattctgcgctcaaaacgtggcccgttggtcatggaggtaaatgcgtctcccggcctggaaggcattgaaaccacaagcggtctggacattgcaggcatgatgatcgaccacattgaacggcatgctacccccgggctccgtcctaaaaccgcgggttgacccgcgttttccagtggttttcgtggaatctcacccggtttttccgtaagctaggtcgcttatttatcaccccatgggattttacaatggattctcttgtcgttccggatatcgacctgctgcgtcgttggctggatcagcaaaatatcacttggtttgaatgtgatgcttgccaggcgcttcatttgccgcatatgcaaaacttcgacggggtgtttgacgctaaaatcgacctggtcgataacgtcattctgttttcagcactggcggaagtcaaaccgaccgcattaattccgctggtgggtgacttatcgcaaatcaacgccagttcgttgacggttaaggcgttcatcgatatacaggatgacaatctgcctaagcttattgtttgccagtcaatgatgaccacggccgggttaaccttcggtcagttctcgcattttatgaagcagagtgaagaagagatttccatggtcatcatggaagcctttgccaataatttgctgatgataggtgaagatgaagagcatgttgcaagcagcgccatgcattctgtcctgcattaagcacctgcgttgattaagccgtcatcattgacggcttttttatttccgacgcgccctttgttacctgccgcgtatttcccctcctggctgacgccacaacgacgatttttgcggttcagcgcctgtaattcttaatgttatcaattgtgaacaacacaggttaatttataaccgtaatgttttattctgcattaagcccttaattgccagattaatgacgttgtttatgccataaaagccgaacctcatagcttaaacatgcataaaatattgagttcaggcgttttttacgctgagatctggttaaccctgaacgggggggctatgcttgcggggcggcgacaacagtgagaatgccgtgcaggtataggtttttactattaaacgtccactgaataatgattcattgtgtaactgatttttaatcactaaacgcaaaaccgaatcactgatgtgcagcgttgttataacccgctcaggaggattaaaagcatgttcaaccaacgtcaaaaatggttgtcaggtgtggtggctggggtgctgatggctgcttcagccagtaccatggcggaagataagacgctgcacgtttataactggtcggattatatttcgccagataccgtgcctaattttgaaaagcagaccggtattaaagtggtctatgacgtgtttgattccaatgaagtcctggaaggcaaactgatggctggtagcaccggctatgacatcgtggtgccttcatcgagtttcctgggacgtcaacttcagtctggcgtgtttcagccgctggataaaagcaaactgccaaactataaaaatctggaccctgccttgatggcgaaagtcgcccagcatgacccggataataaatatgccattccatatttgtggggcaccaccggaattggttataacgtcgaaaaagttaaagccgcgctgggcgctgatgcgccggtaaacagttgggatctggtgatgaagccagaaaacctggaaaaactgaaaagctgtggcgtttctttcctggatgcgcccgaagagatctttgccaccgtacttaactacctgggcaaagatcctaacagcagcgatgcgaaagattattccggtgccgcgacggatctcttgctgaagctgcgtcccaatattcgttacttccactcttcgcaatatattaacgacctggcgaacggcaatatctgtgtggcgattggctggtcgggcgatattcttcaggcgaaaaaccgcgcggagaaagcgaagaatggcgtcaacattggttacagcgtaccgaaagagggcgcactcgcgttcttcgatatgatggcgattcctaaagacgcaaaagatattgatgcggcttacgcctggctgaactacatcatggatccgaaagtcattgctgacgtatccaataaaatgaattacgccaacggcaataaagcctcactgccgttaattaatgccgatatccgtaacaacccgggtatttaccccacaccggatgcgatggccaaactgtttgtgctgaagattcaggacccgaaactggatcgcgtgcgcacacgtgcatggactaaggttaaaagcggtaagtaattcgacagcatatgttatgcaacagcaacagaggcgcagtacaggcctctgttgtgccatttttagcggcactgtttgccgcgttgttccgcctggctccggagaactacattcgtgaacgatgccatccctcgcccgcaaaataaaacagcaaaagcgttaacgccgctgctggaaattcgtaatctgaccaaatcctttgacggccagcatgccgtggacgacgtcagcctgaccatttataaaggcgagatttttgccctgctcggcgcgtccggctgtggcaaatcaaccctgttacgcatgttggcagggtttgaacagcccaccagcggccagattgtattggatggtcacgatctgtcgcatgtcgcgccctatcaacgtcctattaatatgatgttccagagctacgcgctgtttccccatatgacggtagagcagaacattgcttttggcctgaagcaggacaaactggcaaaaggggaaatcacccaacgcgtcgaagaaatgctgtcgctggtacacatgcaggaatttgccaaacgcaaaccgcaccagctttcgggtggtcaacgtcagcgcgtggcgctggcgcgcagcctggcgaagcggccgaaactgctgctgctggatgaacctatgggggcgctggacaaaaagctacgcgaccgcatgcagctggaagtggtggacattctggagcgcgttggggcgacctgtgtaatggtgacgcacgatcaggaagaagccatgacgatggcagggcgtattgccatcatgaaccgcggcaaattcgtgcagatcggtgagccggaagagatttacgagcatcctaccagccgctacagcgccgagtttatcggctcggtaaacgtgtttgaaggcctgctgcgcgaacgtcaggaagacggtctggtgattgacagccccggcctgaagcatcctcttaaagtcgattcagacgtatcggtggtggataacgtgccggttcacgtcgccctgcgccctgaaaaagtaatgctgtgtgaagacgtgcctgccgatggttgtaactttgctgacggtgaggtggtccacattgcctatctgggcgatctctccatttaccatgttcgcctgcacagcggccagatgcttagtgcccagctacaaaatgcacatcgctaccgcaaagggttaccgacctggggcgatcaagtgcgtctgtgttgggacagtgacagctgcgtggtattgacggtttaaggaggcgcgatgaaccagatttttcaacgcacgaaagccccggctaagctgctcggtacgccgttgcagcgctgggcaacgcgcataaagatgcagcacgggcgcaagctcgtcattgcattaccttacctgtggctgattctcttttttctgctgccgttcctgattgttttgaaaatcagcttcgcggatattgcccgggcgattccgccttataccgagctggtcaactgggctgacgatcaactcagcctggtgctgaatctgggcaactatgtcacgctgagcgacgatccgctgtatatcgacgcctatttacagtcgttaaaagtggcggctatctccaccgtgatctgcctgctgattggttatccgctggcgtgggccgtggcgcacagcaagccttcgatgcgttctgtcctgctgttactggtgatcctgccgtcgtggacgtcgtttctggtgcgggtttatgcctggatgggactgctgaacaacaacggtattcttaaccgttttttgctgtggacaggcgtgatcgaccatccgttagtgattctgtataccaatacggcggtctatatcgggattgtctactgctatctgccctttatggtgctgcctatttataccgcgctgacgcgaatcgattattcgctggtggaagcctcactggatctgggcgcgcgcccgctgaaaaccttcttcagcgtgatcgtgcccctgacaaagggcggtatcattgccggttccatgctggtgttcatcccggcggtgggcgagtacgtgatccccgaactgctgggcggtccggacagtattatgattggccgtattctttggcaggagttctttaacaatcgtgactggcctgtagcctctgcgctggcggtgatcattttgctgattttgattctgccgattatttggttccacaaacatcaaaaccgtgaaatgggagagaagggatgaacaatctgccaacgatccgctctccctggcgtacggcgattttagcctgctgctttttgtttctttatgcgccgatgctgctgctgctggtttactccttcaacagttcgcagctggtgacggtctgggaaggcttttcattcaactggtatcgggtgctgtttcaggacaatgccatgatcgatgcggtgctgctgagcctgaccattgccgggctttcagcctcgatggcggtggtgttgggcacgatggcggcggtgattatcgtgcggtttgggcgctttcgtggtcataacggctttgcctttatgctgaccgcaccgctggtgatgcctgatgtgatcaccgggctgtcgctgttactgctgtttgtcggcttaggaaatgcgctgggctggccaacggaacgcggtacgcttaccatctggctggcacacgtgacgttctgtaccgcttatgtggcggtggtgattaactcgcgcctgcgggagctggaccgatctatcgaagaggcggcgatggatctgggcgcgacgccgttgaaagtcttctttgtgattacggtgccgatgattgcgccagcgattgtgacgggctggctgctggcctttacgctgtcactggatgacctggtgattgccagctttgtgaccgggccgggcgccaccactttgccgatggctattttcgccacggtgcgacgtggggtgaatccggagattaacgcgctggcttccctgatcctgttcgttgtgggcatcgtgggctttattgcctggcgcgtgatggctcatgaagaaaagcagcgtataagcgatattcagaaagcgaaacgtggctaaaaccgccgacttttgccattctgtgacgaggctggttaatccagcctctttatcgtcatggtggagtaaaaggcatgtcggaaacccttaagcacggctctgttttaccctctgccccggtgcccgtcacggtggctggcgtggcgattattgccacgcgctgtctgagcgtgctgatgctggcgaatgcgctgggttacgccgaaatagctaactttgtgcaccgcagtgcgcagtcatgggattccacgctgatctttatcgccagtcaggtcattttcttatttgaactgcgttgtgcttttaccctgatgcgcggcagcaaccggggacgctggggattcgtggtggcgcaaatcgtggtgctgttttatatgctcatggcttccaccggctggatctacccggaaatcttcagcattcaaggggataataacctgcagattatccatcgcacgctgctgcaaaaactgcccgatctggtggtgctgttgctgctttttctccccgccagcagccgcgcatttttccgtaagcggtgatacaatcgcgctccgccaacccttccgaccgttaacacaggctttaccatgcactgcgcgctctatgacgctaaccgttgccgctcttgccagtggctcgaaaaaccctatccccagcagcttgatgagaaacagtcccagttgacccagttgctggccgcgttcccggttaaacactggctgccgccggtcacatcggctcagcaaggattccgtaataaggcaaagatggtggtgagcggcagcgttgagcgcccgattttcggtatcgtacagcgtaacggtgaggcgacggatctttgcgcctgtccgctctatcccgacagcttttccccggtactggcgagcttaaaaccctttatcgcgcgcgcaggcttaaccccttacaacatcgaacggcagcgcggtgaactcaagtatttgctgctgaccgaaagtacccagggcgggatgatgctgcgctttgttctgcgatcgcacaccaagctggagcaactgcgaaacgcactgccctggctacagcagcagttgccgcagctgagagtgatttcagccaacattcagccggttcatatggccattctggaaggggatgaggagatcgcgctgacgccaacgcagtcgctggccgacgtttttaacggtgttccgctgtggatacggccccaaagttttttccagaccaatccccaggtggccagtgcgctgtacgcgacggcgcgcgactgggtgcgtcagcttccgattaccagcatgtgggatctgttttgcggcgtgggaggatttggcctgcattgcgcttcaccagaggtacagctgaccgggatcgagatcagtgctgaagccattgcctgcgcgcaacgctcagcacaaatgctgggtctggataacgtcagttttgccgcactcgattccaccgcctttgccactgagcgtgatgcggtgccgcagctggtgctggtgaatccgccgcgccgggggattggaaaggggctgtgtgattatcttcgcacgatggcgcctgactatgtgctctattcaagctgtaatccgcagacgatggcgcaggatattgcccggctgagcgattacgatgtgactcaggtacagctgttcgatatgttcccgcatacggcgcattttgaagtgctgacgctactgacgcatcaacggctgggtgggccagtcaggtaatctgctgaactgaggacagtgcagaaccggtcagcagaacacgccgctggcccataatacttattcagggaaccatttctgattaattttctgccagctaccgttcgcttttaacgccgtcagagcctgattaaatttatcgcgcagtgggtcattacctttgcgtactgcaatgcccaggccggtaccaaagtaatcggcatccgttacgtgctcaccgacgctggccagttcgctgttactttttaaccactgattgacgactgcgctgtcaccaaatacgccgtcaaggcgaccgcttttcatatccagaatggcattctgatagctgtcatacgccacgactgtaatttctgggtgcttgtcctgcagatatttctggtgcgtcgtaccattctcaacgccaattcgtttacctttcaacgcatcgacagaactgaacttccctttcggcgcaatcacgatggcggagttcgcgtaatagggttgagtgaaatcaacctgcttgctgcgttcggcagtgatgtccatacccgcaatgacggcgtcatagcggcggaacttgagcgaagggatcaggctgtcaaacgctgtattagtaaatgagcattccgctttcatctgcgcacacagcgctttcgccaggtcaatgtcgaaacccacaatctggttgtcgctgttcagcgattcaaaaggagggtaggtagcagaggtggcgaagcgaatcttgtcagccgcctgggcgcttaccgccaggcttgccagtacagcggcaatcatccattttttcattacaggctcccgttagccatcaataacacagcaagtgaatgcgccacacgatgccagtaaatgaatttttatgcaataaatatgattataaaattaatcaggcaggttgccctgccaaaggattaattccgccgttcaaacgccagggcgcgtttttcaatcaggcgcatcatgagggtaagcagaccgttaacacacaggtaaatcagccccgcagccgcgtaaaccgtgacgtcataggttcggccatacagcagttgaccatgccccatcacctccatcagcgtaatagtaaacgccagggatgtgcctttaaacaccagcaccacttcgttggagtaggaagaaagcgcgcgcttaaacgcataaggcagcagaatacgcagggtttgccggggcgtcatgcccagcgcttcacaggactgccactgaccagcaggaatcgcccgaacggcaccgtaaaacagctgcgtcgtataggccgcgctgttgagtgacaacgccagcatggcgcacagccatggctgcgacagcaggtgccataaccagggcaccgtttgcaggctaggaaactgccccggtccgtaatagatcaggaagatctgcaccagcagcggcgtgccggtaaacagggtaataaagccttttaccagcggtgaaaacagcggcgttttcaaggccagcacgatggtaaacattagcgacagcagcagcgcggtcacgagggaagcggcggttaagctcaggctggtattcagccctttcagcagttcgggtagatagtgcagcatcagcggtccccccgctcaaaacgggtggtgcgccgttcaattcgacgcagcacggcctgactgaacagcgtgatcagcaggtaaatggccgccgccactaaaaaccaggtgaaaggctcctgggttcgggtcgcgatacttttggtctgcaacataaggtcgttaacgctaatcagcgacaccagtgcggtatctttcagcaacaccagccactggtttcccaggcctggcaacgcatgacgccacatttgcggcatgatcaggcggacaaaaatcgctgactttttcatgccgagcgcctggcctgattcccactgcccaatcggcacggctttcagcgcgccgcgcagcgtttgcgacgcataggcggcatagagcatcgccagcgccatcacgccacagagaaacgggctgacgtcaaaattttcaatctgcatctgaaccggcagcctgaaaaagccgaagttcaggacaacgccatcagataaggtcagtaacacctgtgatgcgccaaagtagataaacagcacgaccaggatttccggcaggccgcgaatcagcgtgaccagagcggtaccgatccatgccagcggcttcagccgcattgactcccagccggcaaaaatcatcgccagcaccaggccagcgatgagggcacaaacagcaaggccgacggtcataccggcggcgcttgcaagcgggattatttcattcatcagaaattactgctggaaccatttgctgtagatggttttgtaggtgccatcggctttgattttatcaagcgcggcattgaatttgctttgcagctcagtatttccctgacgaacggcaatgcccagaccggttccgaaatagtctttatcggtcactttctcacccaccggggccaggtttgcgttctgcttaagccactcgttgacgaccgcgctgtcgccaaaaacggcatcaatgcggccatttttcagatccagcaccgcattctggtagctgtcgtagggcaccacggtaatatccgaatgcttatcagtcaggtatttttgatgggtggtcccgttctgtacgcccacgcgcttgcctttcagcgcttcaatgctggcgactttgcctttctgcgcaacgaaggtggcagaattgtcatagtaaggtttgctgaacagcacctgcttttcacgttcaggcgtaatgtccatgccggccatcaccgcatcaaaacggcgaaatttcaggctggggatcaggctgtcgaacgcctgattggtgaacgtacaggtcgcatccatctctttacacagcgcattagccagatcgacatcaaagccctgaattttgttattcgcatcaacaaactcaaaaggaggataggaagcctcggtagcaatacgaatggtttcggcagcggaagcgctcaggcttaatccggcaagcagtgcagcaagtacgacttttttcattgttagcatcctgacttagtgcgaaagatagtgtgcaaacgcctcggtttgcggctgtgtaaagcggctggcatcgccctgttccacaatgtgaccgttttccatgtacaccacgcggctggccgttttacgtgccacttccacttcatgggtgacgatcacctgagtaatctgggtctgcgccagttcgcgaatgatactgacgatctgtgcggtgatctcgggatcaagcgcggcggtaggttcatcaaataacagcacctgcggctccatcatcagcgcgcgggcaatggcaacgcgctgctgctgtccaccagaaaggtgcagaggaaagcggtcgctgtagctagtgagacgcaggcgatcgagcagtttgtcggctctggcccgggcatcggctttgcttaaacccagtacgcggcagggggcttccatcaggttttgcagcacggtcaggtgcggccagagattgtactgctggaaaaccattcccacgttttgacgcagttcacgtatcgcggcctcagaaggggttttgctgaagtcgaaattattacctgcaatgtgcaactgaccggaacggggatgctcaagcagattcagcacacgcaacagcgagcttttgcctgcgccacttgggccaagcagcaccagcgtttcgccctgcggacactccaggttgatatcaaacagcgcctgatgagcaccgtagaaacaattaatcgcgtttagttgaatactcatgcgccaattttgaatagctattagttttgcggattttaacgtcaccaaaatagttatgcaattaaggtggcttaaaatttacgaataagcggtaaacacccaaaagattagcacaagatgttgtgaggtgaccggcaggcgtttctggaaagcagacaggatgccgtctgaaaacgcacggccttcaggccggcgctttcagacgtgaaagtgaatcagacgtgagaacgaacagggtttattttttcgccttttcaagcatctggctcagcgaaccgcctgcgggatgcgatccctctgcgacatagcgcacatcgtccaccacccagcaactgccctggtggatcatcagcacttcatcctgccactgcttattgtcgcggctcatttttacccgcagcggaatattgcgggcatcccggttcgggatggttgatgcatcggcaacgtcagcctgagcgggcccctgagcaaggctggagaacacatcgccgttgcgccatttggcggcattttggctttgactcgcttcctgaagcgaatgataaagcccttcgctcaggtagggacgatagtttgccagtgtcgtgctatcaggcagaccggaggtaggatgttcaatccgcatatcatagaacttttgtgccacggtgtccgggccgccttcaatgcaaggggcggttcgtgggccattatccttggttaccggctctactgtcgtacaggcactcagcagtagcgcggccgggagcaaaagcgcaaaacctttgtttctcatctcgatttccttattgttctctggcaaggtgcctttttaacatagagtatagttctgcttttaggtgaaagagcctttggtcggtttacgcaacgggagaacaggatgaaattttcgacgacgcccacgctggaaggccaccgtattacggattactgtggcgtagtgaccggggaagcgattctcggtgctaacattttccgcgattttttcgccggtatccgcgatatcgtcggcggccgctcgggcgcttatgaaaaagaactgcgcaaggcgcgggagatcgcattcaaagagctggaagagcaggccaacgcgctgggggccaatgcggttgtcggcatagatatcgattacgaaaccgtgggtaaagacagcagtatgctcatggtgagcgtgacgggcacggcggttattatttgttgaaacggctgctgctactgttgacggtctggctgctggtgggctgtcagtcgggcatagaatcgcgaccaggctactgggtcgatctgcgtcaccctgcacagggcgcgcgaccacgggttaaagtggtggtgatacattataccgccgaggatttttcctcttctctggcgacgctgaccgatcgtgaggtcagcgtccattatcttattccccgccagccgccgcagcgtaagggccagggcattatctggcaactggtaccggagacggatctggcctggcacgccgggccaagtttctggcgcggcgcaacccgcatcaatgacacatccgtcggtatcgagctggtcaataacggctatcgccggacgctcaccgggctgacgtggcaagcttttccgcctgggcaaatccgcgccctcatcgcccttatcaacgacatcacccgacgttatggtattgcgccggaaaatatcgtgggccacagtgatatcgcccctcagcgtaaacaggacccaggcccgcagtttccgtggcagcagctggctgaacagggcattggggcctggcccgatccgcaacgtgtcgctttttacttagccgggcaggatcgtgaagcagccgttccggttcccctcctgcttgatcgtttgcagcgttacggctatcaggtaactgaaggaatgacggcgcgtgagcaacagaacctgattgcggcttttcagatgcatttccgtcctgctcactatcaggggttcgcggatgctgaaacgctggcgattgcggaggcgctgctggaaaaatatggggaagcgcaataaccggcggttactgcgcttccaatctagcgacccgcgtaaggggacgccgacagggtagatgtgttgacggcggcatcgggacgatgctgcgctaaaaacgcccgccagtaggccagtaccttttccagcaccgggcgctcagcatccagatgggtgacgattcgggtgacgggaccgacgctcatcaggacatcatgggatttcatccactggcccagagcgttaacctggtctgacggcacgcgcacgaacagcatatttgtctgctgctcggtcacctcgacgccgattttctgcaactcctgtcccagccaggcggcattctcgtgatcggtctgcaaacgcgcaacgttatgttgcagcgcatacagtccagccgcggccagcacgccagcctggcgcataccgccgcctgtcatcttgcgccagcggcgcgcacgttcaatataatccgcatcgccacagagcagcgaacccacgggcgcgcccaggcctttcgacaagcagatggttaacgtatcgcaataacgggcaaggttttcaagggtggtttgctgcgccacgacggcattaaaaatacgcgccccgtcaatgtgcagcgccagcttatgctcgcgggtgaaatgccacgcctgctccagataggctgcgggcagggctttgccatgatgggtgttctcaaggctaagcagtcgggtgggcgcaaaatggatatcgtcgggtttgataaattcggccaccacatccagcggcaagctgccatcggcggcagcgagaatgggctgaggttgaatgcttcccagcactgctgcgccgcccgcttcgtacttatagttatgtgcctgctggcccacaatgtactcttcaccgcgttggcagtggctcattaacgccaccaggttggcctgcgtaccggttggcaaaaacagcgcagcggctttgccgctcagtcgtgccgcttcggcttcaagtgcgttaacggtgggatcgtcccgataaacgtcatcgccggtttcagccgtcatcatcgcctgtaacatggcagcgctgggacgggttacggtatcactgcgtagatcaatcacattgtgctcctgggcagcggaaagccaggcgggcggaaagcccgcctgaaacatccatctgttttaccgcagccagttagtttttgccagttcaagtacttcgtcaccgcgaccgtttatgatggcgcgcaacatgtacaggctaaaccctttggcctgctccagcttaatctctggcggcatcgccagttcctctttcgcggtaatcacatccaccaggaccgggccatcgtgagcaaaggcctgttccagcgcgccattcagctcggaggctttctccacccgaatgcctttcacgccgcaggcctgagcaatggcggcaaaatcaggattgtgcaggtcggtgccatcggtgaggtaaccgcccgctttcatttccatggcgacaaagcccaaagagctgttgttgaaaatcaccagttttaccggcaacttcaactgggcaacagtcaggaaatcgcccatcagcatactgaatccgccgtcgccgcatagcgccacgacctggcggtcacggttaagtgactgtgcgcccatcgcctgtggcatcgcgtttgccattgaaccgtggttaaaggaacccagcaggcggcgtttgccgttcattttcaaatagcgtgctgcccacacggttggggttcccacatcgcaggtgaaaatcgcgtcgtcggcggcgagctcactgatttgttgtgccacatattgcggatgaatcggctggtcatcattggctgttgccagcgaatccagatctttacgcgcctcggcataatgcttcagtgcactgtccaggtgacgctgctcggttttgacctgcagtttgggcagcagagcacgcagcgtggttttgacatcgccgatataggcctgatccacatggcagtgcgagcccaggctgccggggttaatatcgatttgaatgattttcgctttttcagggtagaaggcgcggtaagggaactgggtaccaagcagcaccagggtatccgcattcatcatggcatgaaagcctgaggagaaaccaatcagcccggtcatgccgacatcatagggattgtcgtattcgatgtgctctttaccgcgaagcgcatgcacaactggcgctttcagcatcgccgccaactcgacgacttcacgatgtgcacccgcacaaccactgccgcacatcagcgtaatattggtcgcgccgttcagggtttgcgccagggtagacagctcatcggcggacggtagcacgaccggcaactgcggcggataccagtctgcgcgtgcggattccggtgctggctgcagcgccacatcaccgggcagcacaatcacggatacgccgcgattcagaatggctttgcgcatggcaatgcccagcacctgtggcagttgctcgggattcgacaccagctcgcagtagtggctacattcgcggaacagctcctgaggatgggtttcctgaaaataaccactgccgatttcgctggagggaatatgcgcggcaatcgccagtacgggcacccggttgcggtggcagtcaaaaagcccgttaattaaatgcaggttaccgggaccacaggagccggcgcacaccgccagttcgccactggcgtgcgcctctgcgcctgccgagaaggcagccacttcttcatgtcgggttggcatccactcaatggtgcccattcggttcagactgtcactcaggccgtttagtgagtcacctgtgacgccccaaatacgttttacgccggcgttttccagggttttggccaccagcgccgctacggtttgtttcatcttcttctccttggtaatccgtcgccatccaggggatagcagaatcaaacaactcaaagaagcgtagacgacgctgattcaactcaaccgtaaaaaattgcatcaaaagttgaattggacggtcaggcggagaacagggcgatgagtaccggtgccagcaggctcatgacaaagccatgtacaatcgcggccgggacgatttctgtaccgcctgcctgttgcaaaaccggtaaggtaaaatccatagaggttgcgccgcataagcccagtgcagtactgcggtgacgggcgatcagcgcagggatcaacataatcgcgataagctctcgcagcagatcgttgaagaaggcggcgctgccaattaccgggccgaaggcttccgtcatcagaatccccgataaagagtaccagccgaagccactggccagggccagcccggttttcagcggcagtcccagtaccagagccgcgatcattccccccagcagcgcactgagcagcaccgcgagcgcgaccatcatgccacgacggtttaagaccatctggcgcaacgtcatcccactaccgcgcagctgaatgcccaccagcaggagcagaaagattaatgcatattcactggcggcggcggcatgatgcagccagggccattgggtcaggcccagcgcaaagcctacgacaaccacaccacataacgtcagtgattccagcgccatatgcagacgtgaaggaagcttttgcggtttgtgactgtgctgccagggcagccgttgctccagccaatgcaacgccagcaggttacatagcagaatgcatgtcgctgttactgccgcagtataaaacaccgtaagcagattgctgctgagattatcgagaaaggccaggctgatgcccataaaaaacagaatgacgtagaccatccagcctaacagtcggttgacggccttgagaaacgtcacgtgtcgaagcggtaacagccagcctgccagcaggggcaacaggataattaagagtccggaatacatattgatcggttcgtccatgtcgaaagtctcgacacgctagcgaaaaagcccgggtgagtaaacccttacaacaaagtgacttgaccgcctgatgaagccgcttcattctgcggacaacaaagaggataaaaacgctatgattctggaacatatcgatatccggggatttcgcggcattaatcagctctctttacccctgacgcgtataaacctgctgattggcgaaaacgcctggggtaaatccagtttgctggacgcgctcagcctgctgctgtcgccccactcgcgcgagtatgtgttttctcctgacgattttcactttacgccgggcgaagtcgacgatcgggttcatcgcctgtcggtcgttttccacttcagggatgacgacgcagaaaacagcgacctgctacagccgttctggcaacccgccgaacagggacaacgccgactgagttacagcgtgcacgcccggcgacgtgacggccagatcacctcaacacggcgctttatcgatagccatggtcatgtgctagcggaagagggaagtgcggcggcgataagttatctgctgcgcatgaatccagtattacggctgcgcgatgcacgttttagccgacgtgttcgcccggtcgaaagcggtattgatgcccgtctgtccaccctgaatcaactggcgaaagagctggataaactgactcgggatctggaacagcatccacagcaattgagtaatgacatgctgcgtcagggattacagaccatgcagcagctgatggaacactactttctggttcagcatcctgagaatggcggacagatgcaccgcgtcgatccacaatcacgtgacggtattcagggctggcgttcactggaccagctgaatcacctgattgccgccacggacgtccgcagccgccaacttattttattgcgcatgtttagcttgctggtccaggcgcgaggaagcgaacctttggctccgggcgcccggcctttgctgctgattgaagatccggaaacccggctgcatcccatcatgttatccgtggcatggaaccttctcacgctgctcccgttacagaagattgcgacgaccaattctggagagctgctttctcaggtcgcggtggagaacgtttgccgattggtacgtgagccaacgcgcgtggccgcatggcgcattggtcccgaagggctgagtgcggaagagagccgccgcatcggcttccatatcaaagtcaaccggccttcagccctgtttgcccgctgctggcttctggttgaaggtgaaaccgaagtctggatcatcaacgaaatggcgcgacaatgcggttttcacttcgccgctgaaggaattaaagtcattgagtttgcacagtccgggctaaaaccgttgttaaaatttgcccgacgtatgggcattgcctggcatgtgctgactgacggggatatggcagggaaaaaatatgcagccacggcgcgcagccagctccagcctcatgatgtcgagaagcatcacctgacgcagctcccggcggcggatatggagcagttcctttaccaacatggctttagtgatgtgtatcatgaggcagcgcacctgccgttaaacgtacctgttaatcccaggcgtattattaccaaagctattcatcgtgcatcaaaacctgaactggctatcacggtcgctatggcagcagccgaacgcggcagcgaggcaatcccggaacgcctacgggagatgttttcccaggtgattaccctggcgcagggcaaagcgggataggggttacagcgtaaaaatgccagcgcggcaggctggcatttttgacggagcggtccaacgttggggggatctcaggctacggcctgttgcacttcaacaggtacaatcagactggcatggttgcctttagggccttgatgaacgtcaaaatgaacctgctggcccgcttttagcgttctgtaaccatccatctgtatcgttgagtagtgtgcgaagatatcttctccgcccccgattggacagataaagccgaaacctttggcgttattgaaccatttaacggtacctgtctccatgcttttacttccctcgcaagacattttataagtaggtgaggtcactgaagccgtgagtcgggtttgattaaaactcaatcagcttatgaaggtagaatgtagagaaactgccacggtcgtcaagcaaagcaccgggcaacgtggggaaaaaatcatcaaaatttgaggtagttaacgctatttgaaattttgtgatacaggtcgcgtgcagggttttttgcctgagaatgcattagcgacagtgcacttgacacacgtgttaaactctacagatgaccctggatttgatgacgatgtacagaatcacaacggaacactatggcaaacacaaatgactggctaaattttgaacacttagccgacgaaaaagtacgcgaagggttaaaaccgccttccatgtataaagtcattctgaataatgacgattatacacctatggaatttgttattgacgttctgcaaaagttcttttcttatgatattgaacgtgcaacgcaactgatgctgaaagttcactaccacggtaaagcaatctgtggtgtatttaccgcagaggtcgctgagaccaaagcggcgcaggtgaataattacgcgcgggacaatcatcatccgttgctgtgtacgcttgaaaaagcctgagcctctctccatacaggaagcaggtcagagcgattaactggaggaggtgcctaatgctcaatcaagaactggaactcagtttaaacatggctttcgccagagcgcgtgagcaccgtcatgagtttatgaccgtcgagcatctgttactggcgttgctcagtaacccgtcggccagagaggcactggaagcctgtacggtggacattgtggctctacggcaggaactcgaagccttcattgaacagaccacgcctgtgctgcctgccagcgaagaagagcgtgatacgcaaccgacgctcagcttccaacgtgtactacagcgtgcggttttccatgttcagtcatccggacgcagtgaagttaccggtgctaacgtactggttgctattttcagcgagcaagagtcgcaagcggcttacctgctgcgcaaacacgaagtcagccgccttgatgtggtgaatttcatctctcacggcacgcgtaaagacgaacctggccaggcacctggtgctgaaaacccggttaacgaagagcaagcaggcggggaggaacgtatggaaaacttcaccaccaatcttaatcagcttgctcgcgttggcggaattgacccgctgatcggtcgcgataaagagctggaacgcactattcaggttctgtgccgtcgccgtaaaaataacccgctgctggtgggggaatccggtgtcggtaaaacggccattgcggaaggtttagcctggcgcattgtgcagggtgacgtgcctgaggtgatgaaggactgcaccatctattctctggatatcggctctctgctggcgggtaccaagtaccgtggcgactttgagaaacgtttcaaagccctgttaaaacagctggagcaggataacagcagcatcctgtttattgatgagattcacaccattatcggtgcgggtgccgcatcgggtgggcaggtcgatgccgccaacctgattaaaccactgctttctagcggtaaaatccgcgtgatgggttccacgacctatcaggaattcagcaacatctttgaaaaagatcgcgccctggcgcgccgtttccagaaaatcgacattaccgagccgtcggtagaagaaacggtacagattcttaacggcctgaaaaccaaatatgaagcgcaccatgacgttcgttacaccgcgaaagccgtgcgtgcggcagtcgaactggcggtgaaatatatcaacgatcgccatctgccagataaagccattgacgttatcgatgaagcgggtgcccgtgcacgcctgatgccagccagcaaacgcaagaaaaccgtgaatgtggctgatattgaaaccgtggtcgcgcgtatcgcgcgtattccggagcagagcgtgtccgccaccgatcgcgatacgctgaaaaacctgggcgaccgcctgaaaatgctggtgtttggtcaggataatgccatcgaagccttgaccgaagcgatcaagatgagccgtgcaggtctgggacaggatcgcaaaccggtgggttcattcctgtttgctggtccaacgggcgtcggtaaaaccgaagttaccgttcagctggcgaaagcgctggggattgaactgctgcgttttgacatgtccgagtacatggagcgtcacaccgtcagccgcctgattggtgcgcctccgggctatgttggctttgatcagggtggtctgctgactgatgcggtgatcaaacaccctcatgcggtcgtactgctggatgagattgagaaagcgcatccggatgtgtttaacctgctgctgcaggtaatggataacggcatgttgaccgataacaacggtcgcaaggcggatttccgcaacgtggtactggtgatgacaaccaatgctggcgtgcgtgaaaccgagcgtaaatctattggcctgattcatcaggacaacagcactgacgcaatggaagagattaaaaaaatctttacgcctgaattccgtaaccgtctggacaacattatctggttcagccacttgtcggccgaagtcattcatcaggtggtggacaagtttatcgttgaactgcaggcccaactggatgctaaaggcgtttcacttgaggtcagtgatgaagcgcgtgactggctggcagagaaaggctacgacaaagcgatgggtgcacgtccaatggcgcgtaccgttcaggaaagcctgaagaaaccgttggccaatgaactgctgtttggttcgctggtggaagggggttcagtatcggttgcactggataaagagaaaggccagttaacctatcacttcctgagtgcgcaaaaacgtaaagcggaaggcactgtgcactaagcactaagcactgtgtgacggaaagagaaaaggccggataatatccggcctttttttttattgcctcggctggaggcaatagcatcaacgcaactcagcgactacggaagacaatgcggcctttgctcaggtcgtacggggtcagctcgacagtcactttgtcgcccgtcaggatgcggatgtagtttttacgcattttaccggagatatgagcggtaaccacgtgtccgttctcaagttctacgcggaacatggtgttaggtaacgtatccagtacggtaccttgcatttcaatattgtcttctttggccatcgaatcctctgggtgtactacctttcagttgaaccggcaagataatgcccaattcaacgagttatgtaaagaaccgtcggcaataaagccaacgcatcgccgtgcttcgcttataacgcgagcatgtcggttaaattagggtgtttatgtgacgtctgcgggggattagcgggctaagaatctgaatcaaccggtaacacgcgcacgattgaaacagtcccgagagtgcgatgagattcccagcctggcaattccggcttgaaattcaagcgcggacgacataccaaacgccgctattatagcacttaaccgactttgtgtgtgcaaaacatctgcgcgagctttaaaaaagggtctggttgagccagcaaccgctgtcaacgggttgagatgacaggttttttaccgattccaggtaagcctcacgcgggatttcgaccgcgcccaacgatgccgtatggggattaagtatctgacaatccaccagacatcctttgtgcttaatgaaatgctgacaaaaaacccatagtgcggtttttgaagcattggtttgcaggctgaacatggattcaccacaaaatatctggcccagtgccagcccgtacatgccgcctgccagctgttgcccgcgccagacttcaatggagtgagcatggcccagctcatagagtttcagccatgcgcgtttcacctcaaaggtgatccaggttccttcttcgcggcccacggcacagccctcaacgacatcagcaaaggcttcgttcatggtgacgcgataaggcgattgctgatgaaagcgtttcatactgcggctaagatgaaaatgttcagggatcaacaccgcacggggatcgggtgaccaccacagaatcggatcgcccggcgaaaaccaggggaaaataccttgctgataggcgctgagcagacgggcaggcgaaagatcgccgcccatggccagcagaccattgggctcgcgcagggccatttccgggggaggaaagagcaacgattcccgtgacagttgaaccagtctcatcgcgttacgttatccatcagcttttgcacgaaactataacgcaaagcgttgctggaaacgccagtaacgtccaccttttgcgactaattcggaatgatttccctgctcaatgattcggccgctgtccataaggcaaattctgtccatctgcgccaggcctgtcagacggtgagtgaccataatgacggttttgcctgccgtaagctgctgcagcaaggcgagaatatgctgctcggtggcagcatcaaggccttccgttggctcatccaatagccacaggtcaccgttatgcagcagggcacgggcaagcgccagacgtcgcagttcgcccccagacagcggacgaccgccttcgcccagccaggcatttaatccttcctcgttatccagcaggttctgcagaccagtctgcattaatgccgcagtcagggtttcgtcgctggcgttggggcaggccagcaataaattgtcacgcagggtttggctgaacagatgaacacgctgggtgacaacgctgatgcgttgccggagttgcgcctcatcccactcagtaaggggaactgcgtttaacctgatctcaccttgctgactatcccaggcgcgcgtaagcagcccaagcaatgtcgattttccacagccggtcggtccgagcagtgcaacgtgttctcccgcctcaatgcttaatgaaaactgattcaacactttttcagggcgtcccggatagcaaaaatcaagcgcctgtaggcttacgtgtaatgcaccagaagggataacggttttagagggaaaaacaatcgccggtgtttgttcgataatttcattgacgcgttgggccgccgttatcacctgagacagtggcaaaaatgcgcccgcgaccggggccagggcttcaaaagcggccagagcacaaaataccaccagcgcaatgaatggcccgggaagttgctgctgcgcaatgctctctgcgctgagccagagcagcgcagtaaccgtcatgccgctgcatatcagtaacagactttgcgccagcgcctgtaaacgctcttgttgacgctgcgcctcctgccactgttgttcactgctgtcgagtctggtgcgccagactgcagcattaccatataacgtcagttcagcctgacctgccagccagtgcattaactgcacgcgccagtgcgaacgctgacgggtaatcgcaacgcccgccggtgcgcccaggcggtaaaagagcggtggcaagatgcagagcagggcgagcagggcaccgcccagggtgagagccagctgcaggtcaatcagacttaaaccgaccgtcaccaccacaatgacgataaacgcacccagcagcggtgagattacccgcagatagagatgatccagcgtgtcgacatcaccgacaaagcggttgagcagatccgcctgacgaaaggctgcaagctgagcgggtgccagcgaaatcaaacggctgaaggtgaaaacgcgtaaatgttctaacacccgaaacgtcgcgtcgtgagtgaccagccgttcaaagtaacgggccgccgtgcggataattgccgcgccgcgcacacctgcggcgggaagcatatagttaaaactgtacagtcccgcaacgccagcgacagacgaggccgccagaaaccacccggataaggtcagcaagccaatgctggctaacagcgtgacgatggccagaatcattcccagcgtcagccggaagggatgacgcagccacaatcgtataaaaggacgcagagcagacatcagatgcactcctgttgacgatgttgcagcaattcacggaacggcccaggctgtgaggtaagttgctgccagtggccctgctgcaccagttttccttcctccatgagccagatttcatcccagtcttgcagcgaatcaatctgatgcgtaatcatcagggtggtttgctgcgttgcagcctgatttaacgccagcataacgtgatgttcacttagcgcatccaggctggcggcaggctcatccagtagcaatagctgagccggtttgtacagcgctcgcgctaccgcaatacgctgtgcctgtcccacggacaacgcgttactggcatcgccaggcgcggtatccagcccttcaggcagccgggggaggaattcgttgatgccacaggcggcggttaacctgtccagtcgttcagtatccaggggcgcgtccatgacgatattttcacgcaacgttgcggccggtaactgtgggttttgtccaacccaggcaagatgctgatgccagtcgcgtcgtgccaggtcgcgaagctcaatgccattggctttgagcgaacccttatagggtaaaaaccccagcagggcatttaacagcgcggttttgcctgcaccacttttgccgaccagcgccacgcgcccgcttgcccgtagggtgaaatgtaaagggccgcacagaaccttgccgccgggggcgcagaccacaaggttgtcagcaaccagctccagcggcgaagtggcgctaaacgcgacattacctgaggccctgtctgacgatggtgtgtcctgcataaaccgctcaagggcatctgcaccgccgattgcctgtgccttagcgtgatagaaggtgccaagatcgcgcagaggctgaaagaattcgggggccagaatcaacaccaggaacccggcaaacagcgtgacgcctttaccgtaatcgccaaaatgcagctcgcccaggtacgagaaaccaaaataaaccgccaccacggcgatggctaatgaggcaaaaaactccagcactgaggaggagagaaaggccaggcgtaaaacctccatcgtccgttgacgaaaatctgtcgtcgtggcggcaattgcctgcttctctgcatcagcccggtgaaacagccgcagcgtttcccgtccgcgtaagcgatcaaggaagtcaccgctcaggcgtgccagggccaggaagttgcggcgattagcatcggccgcgcccatgcccaccatcgccataaagagcggaatcagcggtgccgtagccagcagaatcaatccggcggcccagttcagggggaacagggtaatcagaatgcagcaagggattaccgctgccagcgtcatctgcggcagataacgcgcatagtacgcctgcatatcttcggtttgttccagaagcagtgttgcccaactgcctgcgggtttgccctgtatccaggcgggccccagatcggataaacgatccaaaacctgtttacgcagtgcctggcggatggcctgaccggcccgaaagcctgcctgctcgcgggcatagttcagcaccgcgcgcagcacaaagcacaacagcagtaacataaagcggggcaggagggattgcggcgcttgctgctcgacgataagtgcctgcagtaacgaagccagcagccaggcctgcatgataatcagtagtgcgcctgctgaacctaagagtgaggcaagtcgtagccagggaccggcatgatggcgctgttgacgaagccaacgggtaaggtgctgctgccgcgatttgttcatgcgaaacccactgtggcgaagacaaatgaaatgaggcaagtccctcacgcctggcgcatgaatttagcatggtgataataaaaaaggcgactgaaaaacagtcgcctcaaacaattaagatcaggttattaacaacttacttatcgttcttaaccagaccatcaagataacgctctgcatctaaggcagccatacagccagtacccgcagaggtaatggcctggcgatagatatgatccatcacgtcacccgcggcaaacacacccggaatactggtctgggtggcattgccgtgcagtcctgactgcaccttgatatagccattctcaagcgctaactgaccgtcgaaaatcgccgtgtttgggctatggccaatggccacaaacaggccagcaacctccagcgcttccgtttcatcgttcagcgttgaacgcagcgtcagcccggtcacgcccatctgatcgcccacaacttcttccagcgtacgatgagtgtgcagcacgatgttgccgttgctgactttttgcatcaggcgatcaattaaaattttctccgcacggaagctgtcgcgacggtgaatcaaatgcacttcagcggcaatattggccagataaagtgcctcttctaccgccgtattaccgccgccgataacggcgactttctgattacggtagaagaaaccatcgcaggtggcgcaggctgaaacgcctttgcctttaaacgcctcttctgacggcaggccgagatagcgcgccgacgcgcccgtggcaataatcagcgcatctgcggtgtattcgccgctgtcaccggttaaacggaacggacgattctgcagatcaacgctatgaatatggtcaaaaatgatctcagtgttaaatttctcagcatgctcgtgcatgcgttccattaacgacggacctgtcagatcgtgcgggtcgcccggccagttttccacgtccgtcgtggtggtcagctgtccgcctttttccagcccggtaatcaataccggattcagatttgcgcgtgcagcatagacggctgcggtataacctgctggaccagagcccagaatgagcaacttactgtgtttagccgtactcatgcgttcctcagtttcattcgcctgacatagtctgcgattgtagggaataagccgcatcattgacaacacttgcgcgcttttgttggcgattgctgtaaacggcgtagacgatgaatacgtttttcgcctgtcacttgtgccaaaagggggcaaaaattcatttcgttgcaccatgccgcacgaaaatactcatttaaaaacagtgacccagcgaagtgtctggcatcttgtcctgaatttagacattttactttgacaatcgcctgcgcatttgcgaaaacagtgtaagaagcgaatgacatcttcggaacaaaacgggttttgccgccgggttttgggcaatgtgccgaacgaattttgtcgtctgatatgggtcatgacgcatgatgtggacaggcaacatgcgtcatacacataggtgcgaacgcactcagactttgttatttcacttcaaaaaatgccccgaacaatgagcgttttcaggggatggcaggtaaagggaaggaattaagagagacaataataatggtagataataagaaacgccccggtaaagacctcgacaggatcgacagaaacattctgaatgaattgcagaaagacggtcgcatctcaaacgtggaactttccaaacgtgtaggattatcgcctacaccttgtcttgagcgtgtacgtcgtcttgaacgccagggattcatccttggttatactgcgcaacttaaccctcactacctggacgcctcattactggtattcgttgagattactctgaatcgtggcgcgccagatgtgtttgaacaatttaacgccgccgtacaaaaacttgaggaaactcaagagtgtcacctggtttctggtgatttcgactacctgcttaaaacgcgcgtgcctgatatgtccgcctaccgcaagctgctgggtgaaaccttgctgcgcctgccaggtgtaaacgacacgcggacttacgtggtgatggaagaggtcaaacagagtaaccgtctggtgatcaaaacgcgctgatgcgtggcaggtgcaaagcctgtgaaatttcggtacactcctgtgaatacatacaggaccagcgtcgggtgagcccggcgctgttgtttcttactttacaggcacctggagagttctcttgagccaggaatacacagaagataaagacgtttcgttacagtcgctgagcagtggacgccgtctgctggaagcgttgctcatcctggtggcgttgtttgccatctatctgatggtttccctcgtcagttttaatccttccgacccgagctggtcgcagacggcctggcatgaacctatccataatattggtggcaaggtaggcgcgtggctggctgataccttactgttcatctttggtgtgatggcgtacgccattccgccggtgattttggggctgtgctggatagcgtttcgccagcgcgataatcaggactactttgactatttcgccatcggtttacgcttaatcggcgtactggcgttggtggtgaccacctgcggtatggcggcactcaatgctgacgacatctggtattttgcatcgggtggcgtcatcggcagtctggtcagtaatgcgatttcgccctggtttagtccagcaggcggaacgctgacactgctctgcatctgggctgccgggattacgctttataccggctggtcatggttaaccattgcggaaagaatcggcggcgttgttatgggcgtgctgacctttgccagcaaccgttcacgccatgacgaaccctggcaggaagaggatgaggcagaacatcatgaagaggctgtgcctgtccttcacgctcagccgcatgaagacgatgacgttttgcttgccgcaccgcgtaaagctcagcccgatctggatgagcacgatccgctgctggctaaggcggcaacagccactcgcgccgccgtcgctgcaaccgtcgacgcttccgatatgccggtggcgtccgctgcggtgccgacccagcagcctgccgttgccccggcgctgtccagtgcggcgaccgcacagtcagtagcccctgtcgctcagccagtgggcgctgtacctgcacaatccgcccattttgccgccgcgtccgcgcaggaatcggcagcacattattctactcccgcgcgcaatgctgcgccgcttgatcctgttccgcaggataaaccggtgagcgaaccacctctgtaccgttttgaaatgccggatgaaacgcctgcatcctcaagcccctttacggcttatgaggatgatgagccgaaaatgggcaactggcgcgaggcagcctctgccgcgacgctgagcagcgcggtgacatcagccgttgccgcaaagcaggcgtcatcgatgtcgcccctgtttgaaccggtacctgaaaatcaggcgaatcctcaggtgaagcaggggattggcccggcgctgccccggccgaatccggtgaaattaccgacccgacgcgaactggcctcctatgggatcaaactgccttcgcagcgcatggcggaagagaaagcgaagctgtctgaaagccccgcgtctcagccagtgcctgaggatacgcacaacccggactggtctgcagaggagcaagacgcgctgcaacaggccgagttacgccacgcgtttcagtcggaacagcaacagcgttatggcgagcgctggcaacaggatgagcagcacgaggacgatgaactggcactgcaacaggcatcgctggcacgtcagttcgccgaacagcagcaacagcgctatgaggcggagcccgacaacaacgcaccggttttcaatctggatacctcggcggcttttgatttctcaccgatgaaagatttggtcgacgatggacctgttgagccgctgttcaccattgcggctgcgcctgaaacggatgacgtggcggcaaaacatgagccgtggcagcaaatgcaggccgcaccagaacaggcggcagcccagagaacggtgccgacacagagcgtggtgtcggataccttcgtggcccctgttcaacagccagaacccgtcgaagacacaaaaccgtcgctgcatgatagcctgattcaccctttcctgatgcgtcatgagcagccgctggaaaaaccctccacgccattgccttcgctggatctgttaaccgcgccgcctgtcgaagaggagccggttgatatgtttgcgctggagcagacggcacgtctggttgaatcacgcctgggcgattatcgtgttaaggcggaagtcgtcggcatttctccaggcccggtgattacccgctttgaactggatctggcgcctggcgtgaaagccgcgcgtatttctaacctgtcacgcgatctggcccgttcactgtcgaccacggcagtgcgcgttgttgaagtgattcccggtaagccctatgtcggactggaattaccgaataagcatcgtcagaccgtttacttacgtgaagtgctggattgtccaaaattccgtgacaatccttcacctctggccgtggtactgggtaaagacattgccggtcagccggtagtggccgatttggcgaaaatgccacacttactggtagcgggtaccaccggttcgggtaagtcagtcggtgtgaacgccatgattctcagcatgttgtataaagccacgccggaagaagtgcgctttattatgatcgacccgaaaatgcttgagctgtcggtctatgaaggcattccgcatctactcaccgaagtcgtcaccgatatgaaagatgcggcgaatgcgctgcgctggagcgtcggtgagatggagcgccgctataaactgatgtcggcgcttggcgtgcgtaatcttgcgggctacaacgagaaagttgagcaggcggaggcgatgggccgtccaatccccgatccgttctggaaaccgggcgacagtatggacatgacgccaccggtgctggaaaaactgccttacattgtggtgatggtggatgagttcgccgacctgatgatggccgtgggtaaaaaagtggaagagctgattgcccgcctggcgcagaaagcacgtgcggcaggtatccacctggtgctggcaacccagcgtccctcggtggatgtgattaccggtctgatcaaagcgaacatcccgacccgtattgcctttaccgtatcaagtaaaattgactcgcgtactattctcgaccagggcggcgcggagtcgttgctggggatgggtgacatgctctatatgccgccaaactcctccatgccggtccgtgttcacggtgcctttgtgcgcgatcaggaagtgcatgccgttgtgcaggactggaaagcgcgtggccgtccgcaatacattgagagcattacggcaggtgaagagagcgaaggtgcaggcggtatcgacagcgatgaagaactggacccgttgttcgatcaggcggtgggctttgtggtagacaagcgtcgcgcctctatttcgggcgttcagcgtcagttccgtatcggctataaccgcgctgcgcgcatcattgagcagatggaagcacaaggaattgtctcgtcgccgggtcataacggtaaccgcgaagtcctgtcaccaccgccacatgatatgtagagcctgagcgataagctttgaaacataaatcaatgagccagttcttgctggctcattgttttttagcggttaacccccatagttgattaggctttcggttttttctcctgtattaaatgcaggacagcgaccaggcttagtatcgttatcaacgggaaacgatttaataaggatttaagcagatgaaattacgcgtaatcgccttcggcctgatggccgctttgggttcagccagcgctttcgctgatgcatcgactgacctgcaacagcgtttaaataaagtaaacagcttccacgccagctttactcaaaaggttaccgatggcagcggtgctaacgtgcaggacggggaaggtgagctgtgggttaaacgccccagcctgttcaactggcacatgaccgcgcctgacgagagcgtcattatctctgacggaaaatcgttatggttctacaacccgtttgtagaacaggccacggtaagcctgttaaaaaacgccaccagtaatacgccatttatgttgattgcccgtaatcagtcgagtgactggaagcaatataacgtcaagcagcagggcgacaaatttgaactgacgccgaagaaaagcgatggcaatctcaagcagttcacgattgatgtgacaccagatggcaccatcaatcagttcagcgccatagagcaggatgggcagcgcagtaactaccagttaaagagccagaaaaacggccctatcagcccggataaattcactttcaccccgcctaaaggcgtcacggtggatgatcaacgtcagtgaggtggtagtgagtaacctgtccctggatttctccagcgaagattttaaaccactggccgcgcgtatgcggccagaaaccctgaagcactatattggtcagcaacacctgttggctgcgggtaaaccgctgccgcgcgcgattgaggctggccatttgcattcaatgattctctggggaccgccaggaacaggcaaaaccacgctggccgagattatcgcgcactacggcaacgcggacgttgaacgcatctctgctgtcacatcaggcgtcaaagaaattcgtgaagcgatagaacgtgcgcgcctgagcaagcaggccggccgtcgcacgattcttttcgtggatgaggtgcaccgtttcaacaaaagccagcaggatgcctttctgccgcatattgaagacggcacaatcacctttattggtgcaacgaccgaaaaccccagcttcgagcttaattccgccctgttgtcacgcgcccgcgtttatttgctcaaatccctgaccacagaggacatcgagcaggtacttgaccaggctatgcaggacgccgatcgaggctatggcaacagcgatatcctgttaccggataatacgcggcgcatgatcgctgagttggtgaacggcgatgcgcgccgtgcgctgaacacgctggaaatgatggcggatatggccgaaacccgcgcggacgggaaaagggaattaacgccacagctgttaaccgaggtggccggtgagcgttctgcccgctttgataacaagggcgaccgtttttacgaccttatttctgcgttacataagtctgttcgcggttcggcaccggatgctgccctctactggtacgcacggattattaccgcaggtggcgatccgctctatgtggcacgtcgcctgctggcgattgcctctgaagatgtcggcaacgccgatcctcggggtatgcaggttgcgatttcggcctgggattgttttacccgcgtcggccccgcggaaggggagcgggcgattgcacaagccattgtttatctggcctgcgcgccaaaaagtaacgccgtttataacgcgtttaaggccgcgatgcgtgatgcgcgcgaccatcccgattttgatgtccccgaccatttgcgcaatgcgcccactaagctaatgaaagagatgggcctgggtgaaagttaccgctatgcccatgatgaagccaacgcctacgcggctggcgaggtctatttcccccctgaaatggcacaaacacgttactatcatccaacacaacgtggtcttgaaggcaaaattggcgaaaagctggcctggcttactgaactcgatcaaaatagccagacaaaacgctaccgctaaaacagacgttgcggtaatgtggtcaatgttttcaacgcattccagcaggaatgcgtcccttcttttaactcataaatacacaggataagcatgctcgatcccaatctgctgcgtaatgagccagacgcagtcgcagaaaaactggcacgccgaggattcaaactggatgtggaaatgctgcgttcgctcgaagagcgtcgcaaagtcttgcaggtagaaaccgaaaacctgcaggccgagcgtaactcccgatccaaatccatcggtcaggccaaagcacgtggggaagacatcgagccactgcgtcaggaagtgaacagcctgggcgaacgcctggatgctgccaaagcagaactggatgaactgcaaaatcagatccgcgactttagcctggcgctgccgaatattcctgcggatgaagtgccgctgggcaaagacgacagcgagaatcaggaagtcagccgctggggtgagccacgccagttcgattttcaggtaaaagatcatgttgagctgggcgaagccgcgaaagggctggattttgccgcggcagtaaagcttaccggttcacgcttcgtcgtgatgcagggacagattgcccgcctgcaccgtgcgctcagccagtttatgatcgatctgcacaccgagcagcatggctacctggaaacctatgtgccttatctggttaaccacgcgaccctgtacggaacaggacaactgcctaagtttggcgaagacctgtttcatacccgaccgctggaagaggaatcagaaagcagccactatgcactgattcctaccgcagaagtgccattgaccaaccttgtacgtgatgaaatcgtcgaggaagagaacctgccgctgaagctgacggctcatacgccatgtttccgctctgaagcgggctcctatggccgggatacgcgtggacttattcgtatgcaccagttcgataaagtcgagatggtacagatcgtcgcgccagaaacctcaatggatgccctggaagagttggtcggtcatgccgaaaaagtcttacagctgctgaatctgccctaccgtaaagtgctgctgtgtacgggcgatatgggctttggcgccaccaaaacctacgatttagaagtgtggttaccggcgcagaatacgtaccgtgaaatctcttcctgctcaaatatgggggatttccaggcccgccgtatgcaggcccgcacccgtaataagcaggataaaaagccgcgtctggtccataccttaaatggttccggtctggctgtgggccgcaccctggtggcggtgctggaaaactaccagcagcaagacggccgcattgccgtgccagaggtactgcgcccttatatgaagggcctggaatttattggttaatcgcccgtatcctctgaaaaacccagcgcccgctgggtttttttttggtccaaatggcggaacgatgtctacgaaccgcataagcatttatcacaaataaacgttatcgatgtatcgcgctgccggaagcgtaaaaatctacattatcatagagatagctttattttcatcggcgtaaaatatcccgctaacttactgaagataaataaattaaattgtcgggcagcaaaatgtgctgaggcctgtttctccccgttgactttaaaaaacgcaatggcaaactgcgcgcaatttccttcatttcttttggtttttaatccctatgtcgacctggtcacgtcctgtgatattgctgctttgcggcctgttattaatgacagtttctattgctgtgctgaatacgttggttccactctggctgacgcatgatgctctggctacctggcaggtgggcgtagtgagttcgtcatattataccggcaatctgctcgggaccttaacggcgggctggttgatcaaacattatggatttaaccgtagctattatctggctaccggtctgtttgccggggccacgctgtgcatgatgatgatgtcgggattctggtcatggacgctgttacgctttacggcgggcatcggttgtgcgttagtctgggtcgtggttgaaagcgctttattatgtagcggcacggtacgcaaccgtgggcagctgctggctgcttatatgatcgtctattacctgggaacggttgccggccaactgctggtgagcaagctttcgactgagttgttaagtgtgatcccctgggtaaccgcgacggtgatttgtgccattttaccgctcatcttcactcaggttgccacccacagcgacccagctgaagcgctgccgggtggacgcattttgcctatgctgcgtcgccgcagttctcgccttggcatcaacggttgtatcatctcaggtattgttttgggttcgctgtatggtttgatgccgctgtatctttcccaccagggcatgagtgacgcgaacgttggctactggatggcgctactggtcagtgcaggcattgtcgggcagtggccgattggtcgtctggccgatcgctttggtcgcatgatggtgctgcgtgtgcaggtatttgtggtgatcctgggcgctattgcgatgctgaccaatgccgcgatggcacccgcattgtttgtactggggctggccggttttacgctttatcccgtggcgatgtcgtgggcctgtgaaaccgttgcacaccacgaactggtggccatgaatcaggcgttgttactaagctatacgctgggcagcctggccggtccaagcatgaccgcgatgctgatgcagagttattctgaccgcgtgctgtttgtaatgattgcggcagtggcgctggtttacctggttatgctgttgcgtaaagccgatcatcatgccacgcccgtggcgcatgcctgaccgacttctcagagggctgccctgtgcttcgttggcacatcgcagcccgagggttgggtgattcgtttctgtgagtggggtgaattgagcggggtgactattcccggcatcgtcatcaatacatcacttcatgcccgtagctggcgagaatgttttttacccgctccattgtctctttactgggcggcttcaccccatcaagtttgtactcttcacccatcgcaatccatttgtgtttacccagttcgtgataaggcagcagctctatcttctcaacgttttccatatcctgagtaaaagcgcctaatcgatggacggtgtcatcatcgtcagaatagccgggcaccacgacgaaacgaatccacgtacgtttcccttttttctgtaaatagcgggcgaaatcaagcgtgcgatgattggacacgccgaccaggatctggtgaacatcgtcattcatctgtttgaggtccagcatgaccaaatccgtcgcgtccagtaattcatcaataaccggatcgtagcggcgaacaaagccattggtatcgaggcaggtatgaatgccttctgctttacaggcgcgaaaccagtcgcgcacaaactcggcctgcagaatcgcttcgccacccgatgcggtaaccccgccacctgatgcattcataaagtgacgataggacagaacatccgccatcagcgcctcaacggtgatttctttaccgccgtgcgtgtcccaggtatcacgattatgacagtaaaggcagcgcatcaggcagccctggaaaaaggtgataaaccgaataccgggaccgtctacggtaccgcatgattcaaatgagtggatgcgaccaatggctgacattgcgatgtattctccaggtaagcctgcggagcaggtggcacactctctggcgtgctctgaacaggaaatcgattctggtggttatccgtgtctcagacaaccaccaaagcagactttgaataagaggctccatgaaggagcctcagataagcgtagtggctaacgtacttacagggactgtgtaaaggtacgggtaatcacgtcctgctgttgctctttagtgagcgagttaaagcgcacggcgtaaccggagacgcgaatggtcaactgaggatatttttcagggttatccatcgcatccattaacatttcccgattcatgacgttcacattaagatgctgaccgccttcaatgctggtctcatgatggaagtaaccgtccatcaatcctgccagattggttttacgcacgttgtcgtctttacctaacgcgtttggaacgatagagaaggtataggaaataccatcttttgcgtaagcaaacggcagtttagcgaccgaggtcagggatgccaccgcacctttctgatcgcgaccgtgcatcgggttagcgcctgggccaaaaggcgcgcctgcacggcgaccgtctggcgtattaccggttttcttaccgtaaaccacgttagaggtaatggtcagcactgactgggtcggtactgcgtgacggtaggtttcgagttgctgaatttttttcataaaacgttcaacaaggtcgcaagccaggtcgtcaacgcgtgggtcgttgttaccgaactgtggatattcaccttcaatatcaaaatcaatggccaaaccgtcttcgtcgcgtaccggtttcaccttcgcgtatttgattgcagacagtgagtccgcagcgacagacaggccggcaataccacatgccatggtgcggtaaacatcacggtcatgcagtgccatcagcgacgcttcatagctgtatttatcatgcatgaagtggatgatgttcaatgcagtgacatactgttttgccagccagtccatgaagtgatccagacgtgccatcacgatgtcgaaatcaagcacatcgtcggtgattttggcctcttttggacccacctgcattttcagtttttcatccacgccgccgttgattgcgtagagcaaggttttcgccaggttcgcgcgggcaccaaagaactgcatttgcttgccgacgatcatcgggctgacgcagcaggcaatcgcatagtcatcgttgtcaaagtcagggcgcattaagtcgtcattttcatactgcagtgacgaggtatcgatagacactttcgccgcatactttttgaagttaaccggcaggttttcagaccacaaaatggtcatattaggttcgggtgacggccccatggtgtacagcgtgttcaggaagcggaaggtggttttgctcaccagcgtacgaccatcaacacccataccggccagcgactcagtagcccaaatagggtcgccagagaacagttcatcatactcaggcgtgcgcaggaagcgcaccatacgcagtttcatcaccagatggtcaatcagttcctgagcctgctcttcattcagtttgcctgctttgagatcgcgctcgatgaacacatccaggaaggttgaaacacgaccaaacgacatggccgcgccattttgcgattttactgcggccagatagccgtaataggtccactgtaccgcttccacggcattagtggctggaccagagatatcgtgaccatatttggctgccatctctttaatctgtcccagcgcacgatgctgatcagcaatttcttcacgcagacgaatagtggcttccaggtttacgccattttccagatcgctctgcagggaagtaaactgagcaaacttatcagccatcagatagtcaatgccgtataacgcgatgcgacggtaatcaccgatgatgcgcccacggccgtaggcatctggcaggccggttaatacaccggatttacggcagcgtaaaatgtctggggtataaacatcaaacacaccctgattatgggttttacgatattcagtgaaggtttttttcagtgcgacatcaagttcacgaccgtaaactttgcatgagccctcgaccatcttgataccgccaaagggaataatggcgcgttttaatggggcttcagtttgcaggccaacaattttttccagcgatttgttgatgtaaccggcatcgtgggacgtaatggtagaagcaagatcggtatcaaaatctacgggggcgtgagtgcggttttcaactttaatgccttccagcacgctttcccagagtttggttgtggcttcggtggcacctgccagaaaagattcatcgccttcatacggcgtatagtttttctggatgaagtcgcgtacgttgacgctgttctgccattcgccttcagtaaaaccttgccaggctgaggcgagttttgcgttaagttcggtcatattatacctgccttatttaaggagacttttgctctcgggtatatcggattgggatgcaccgtcgagacaggattagtgcgtttcgtgcccaccgcgtaagtaaattacccagtaggtcaatccaactaacaggccgccgccgatgatgttgccgagcgtgaccggaataagattgtcgaaaataaagttttttacagagagggccgggaactgggccgcggtcgtgccagcggcctgccagaattcagggccagaaaaatcacgaataatgatggcgaaaggaatcagaaacatatttgcgatactgtgttcaaaaccacaggcaacaaacatcgccaccggcaaaatcataatcaggcttttatctgttaaggtgcgccctgaatagctcatccagaccgccagacagaccatcaaatttgccaggatgcccagacaaacggcttcgataaacgtgtgatgcattttatggtcggccgtttgcaacacgtttaaaccccatgcgccgttggccaccatatgctcaccggaaaaccacatcagtgtcacaaaaaacagtgcaccggccaggttacctaaataaacgttaatccagttccgtgccagttgcccccaggtgatacggccactcgctttagcgaccacaatcagcacggtagaggtgaacagatcggcaccgcagaccacgacaaggattaagcccagtgaaaaacagataccgccgatgagttttgccataccgtaggccatttcaccgctgccggtggtggccgtaatgtaaaacacaaaagcgatagagatgaacatgcccgcagtaaacgcgagaaaggtcgttgtcaggggatgcttggttgctttataaacgccagcgtcttcagcaactttcgccatcgcggcgggtaataacaggttaaaaggattgtcagctttcacactaactcactccaaaagttgtctgaaaaaataataacaaaggcaacagaggtagaagttgatttagatcatgttcggccgggcaatggcggaaaaattctgacaaaaaagaatggttttttgaataagttattgaaaataaataattaaatttattttaaataatgcaggttttgtttaattgacgaggtgctgcagctgtcgacgtcactgtgctgttaacaaaatatctctattgtgttgtttttattctggataataaaaacgatgatctattaataactgaaatgcttaatgggtaaaaaagaaaggcactaatgagtattagtgcctttgcgtttatcgcaaacttaatctgacagaatgccgcaaataattatgcgttttcccagtagcgacgtttagcacgctgcagtttctcataagccgccagtagcgcctggtgggcagggaaagcggtgagatcgctgtccaccggctggagcccgttgaaggccgcttcaccactgatcgccgcagaggctgcttctacagcctcactaccatacatgcgtacaaaggcagcatgatattccagtggattacgctcatcttccatggccagaagcagcaaggtttgcaggcaacgatagtaatttgcacgtgctgggctgaaaacggagccgttaaactccatggtccattctgtccagattaacgcttgatccaggtcaccacaggccagcgccagcatcgctttaagctcgccgatgcgtaaggtgtaccagccgttatctttacccgttgccagacccagcagctcgcggacgcgggtgaagtcatcaaaaccttcttcgtccagctgagaaatcagatcgagatactcttccggattccagttgcttccaggcagggcaagcagcgtttcacgtatgcccgcgcccatgctgttgttagccagcagcaggtcttcagccggataaatatctgacatgccaggcacgataatgcggcatgcataaacacctaagtgctcgtagtccgcgatatagacttcctgaccttcggccgcgaaaatcgccatcagcgtgctgaattcttgctcggtagtgccatcaaatttccagtccacaaacggataatcagccgtctctttgaacatatcccaggaaatcaggccgcttgaatcaataaagtgtgtttccaggttagcgtgttcagccacttcttcatcatcaaaggtaggcggcgtaaagacgtccaaatccttgaggctacggccctgaagcagctcagtgacggtacgctccagcgccacgccaaagtccggatgcgcgccgaaagaggcaaaacaggtaccgttagcaggattaaacagcacgacgcaaataaccgggtacttaccgcctaatgacgcatcataagcaaagattgggaagccttccgcctccaggcgagcaatggcttccaccacggcaggatagcgtgccatcaccgactcaggaatggtgggaaggctgacagactccgcaataatacggttcttaatgtaacgctcaaagacttcagataatccctgaacccgtgcctcattggccgtattaccggctgacatgccgttcgatacgtacaggttgccaatgatgttcatcggaatataaacggtttgctgatcggactggcgcgtgaaaggcagggcgcaaataccgcgctcgtggttacccgactgaagatcgatcaaatctgacgcagccacttcattttcaggatcgtaaaaggcgcgcagacgcgcatccagaatgccttctggcaggctgtcatcttcaggcagggggaaccacttttcattggggtaatggacaaaatcgccttgagcgatgctgttacccaaccagaaatcggcaaagaagtagttggtggacagacgttcaaaatactcacccagcgccgaagccagggcggctttcttgctggcacccttgccgttggtaaagcagagtgggcagtcgcggtcgcggatatgcacagaccagacgtgtggaacgggattaagccaggaggcttcttctatattaaagcccagatcctgcagtttggtctggaaacgcgtaatggagtcttccagggcggcatctttgcccgggataaaagtttgcgtcatggtgccgctctctctgtaaaatagggtgcgtaaagcgcgcaatgatacgttttttgctgcctgttcgctatcaaggcgcggcaattttaccggacgttttctcataccctggtttatctgccaatgccgagactgaacgaaaggaactcgcctcacaatatttcgtgttggattgcattggtaatataaccttcggtgcgatgtgctggaaaaatgtgaccggtgttagatttatgattgcagccaccagaatgcagtgataaaaccgaatcgttattcataaccgttttatatgacagtggtgagggaaatgacgcaaatttataattttagctctgggccagcgatgctgccgagcgaagtgctccgccgtgcagaacaagaactgacaaactggcacggcctgggaacttccgtaatggagatcagtcaccgcagtaaagaatttattcaggtggctgaggaagcagaggcggacttccgcgatctgctaaaaataccctctaattacaaagttttattctgccatggtggcgcacgcgcgcagtttgctgcggtaccgggtaacctgctgggtagcgccaccagtgcagattatgccgacggcggctactgggcgcacagcgctattaaagaagcggctaaatattgctcgccacgtaccctggatgtcaaaaccacccttgagggtaagcgtgccattctgccgatgcgtgagtgggatgtcagtgacacggccgcctatttgcacttctgtcctaacgaaaccatcgacggcgttgccattgatgaagaacctgattttggcaacaaagtcgtcgttgccgatctctcctccacgattttatcccgcactatcgatatcagtcgctatggcgtgatttacgcgggtgcgcagaaaaatattggcccggcggggattaccctggtcattgtccgggacgatctgttaggtaaagcccataagagcgtgccttctatcctggattacagcgttctggcagaaaatgattcgatgttcaatacaccgcccaccttcgcctggtacctgagtggactggtgtttaagtggctgaagcagaaaggtggtgtggccgaaattgagaaaattaatcaggcaaaagcgggcttgctttacgatctgatcgacaagagtgatttctatcgtaacgatgttgcgctgcaaaaccgctcgcgaatgaatattcctttccagttggcggatgcgtcactcgacagcctgttcctggacgagtcattaaaagccggtttgcacgcgttaaaaggccaccgcgttgtcggcggcatgcgggcatccatttacaatgccatgccgctggaaggcgttaaagcgctgacagacttcatggttgatttcgaacgtcgccacggctgattattccccagtcagcgggactgctgacacccgactccgccatccggcggagttgtcgtttttttgaggattgagtttcacatgcaagattccctgacccttcagcccattgctcgcgttaatggcacggttaatttgcccggttccaagagtgtttcaaaccgtgcgttgctgctggccgcattggcgaagggtaaaacccgactcactaacctgctggacagtgatgatgttaagcacatgcttaatgcgctcaaggctctggacgtggatttcaccctttcccacgatcgtaccgtttgcgaagtgacaggaaagggcggccctcttttggctgcacaaccggttgagcttttcctgggcaatgctggcacggccatgcgcccgctggcagcggcgctctgccttggggcgcaggatgtggtgctcacgggcgagccgcgaatgaaagagcggccgattgggcatctggtcgatgcgttacgtcaggggggcgcccagattgattaccttgagaatacagattatccgcctgttcgcctgcgtggtggctttgttggcggtgaagtcaccgtagacggcagcgtatccagtcagtttttgaccgcgttgctgatgatggcccctttagctgaagagaacacgcgaatcagcattaaaggcgatctggtctctaagccttatatcgatattacgctgcacctgatgcgctgctttggcgttgaggttgaaaatcaaaactaccagcacttcctgattaaaggaaaacagcagtatcagtcaccgggagattacctggtggaaggcgatgcatcttctgcctcctattttcttgcggcggcagcgattaaaggtggcactgtgcgcgtgaccggtattggtcgtaacagcgtacagggcgatattcgctttgctgatgttctggaaaaaatgggcgcatccgtcgagtggggtgatgattacatcgcctgtacggcgggcaaactgcaggctgtcgatatggatatgaatcacattcctgatgcggctatgacgattgcgacagctgcactgtttgctcagggcaccacccaactgcgtaacatctataactggcgggtaaaagaaaccgatcgcctgacggctatggcaacagaattgcgtaaagtcggggctgaagtcgaagaagggcacgattatatccgtattacgcctccggctcagctgacgcatgccgcgatcggaacctataacgatcaccgtatggcaatgtgtttctcgctggtggcgttatcagatacgcctgttaccattctggatcctggctgtactgcaaaaaccttccctgattatttcgagcaactggcaaaaatcagccagaatgcctgatctcctcgcccggtgagtattttgccgggcctgtttctcattcccattcagcaggccagaaaagtcctttttctggcgaaatttcgcatcaccttccctctaaagggtaacgaagcgtcgcagggcagcgtataatggccgacatttgtgacggccaactggccaaaatgcgcgcagcaacaggagggaatgatgacagcaactgccccggtcataactattgatgggccaagtggcgcgggaaagggcaccctgtgcaaagcgatggcggaagccttgcagtggcatttactggattccggcgcgatctatcgtgttttggccttagccgcattacatcatcaggtcgatattgagtctgaagagggactggttcccattgctgctcacctggatgtgcgctttatctctcagaacggcgagatgcaggtcattctggaaggtgaagaagtcaccagcgaaattcggacccaggaagtcagcaacaccgcctcgcgcgttgccgcttttccccgcgtccgtgaggcactattgcgccgccagcgtgcttttcgcgaaggccccggcttaattgccgatggccgtgatatgggcaccgttgttttccccgacgcccccgtcaagattttccttgatgccagcccggaagtgcgtgcagagcgacgtatgctacagttgcaggataagggctttaatgttaactttgatcgccttttagccgagataaaagagcgcgatgatcgcgatcgcaaccgcgctatagcgccattggtgcctgctgaagacgcattagtgttggattcaacacagatgtctatcgagcaagttattgataaggcgctgaattatgcccgaaagacgctgggcatctgatattttggcgtaaacgaatttattaaccctgtgccatggacccggtgcagggcatgtgaaacaaccccatccgacatgaagtcagatggacgttaaattgaagaatcctaagattatcaatatgactgaatcttttgctcaactatttgaagaatccctgaaagaaatcgaaacccgcccgggttccatcgttcgtggcgtcgttgtctctatcgacaaagacgttgttctggttgatgcgggcctgaaatctgaatctgcaattcctgcagagcagttcaaaaacgcagccggcgaactggaaatccaggttggtgacgaagttgacgttgctctggacgcagtggaagacggcttcggtgaaactctgctgtcccgtgagaaagctaagcgtcatgaagcttggatcacgctggaaaaagcctacgaagaagctgaaactgttaccggtattatcaacggcaaagtcaaaggtggcttcacagttgagctgaacggtatccgtgcgttcctgccaggttcactggttgatgtgcgtccagtgcgtgacacgctgcacctggaaggcaaagagcttgaattcaaagtgatcaagcttgatcagaaacgcaacaacgtcgtggtttcacgtcgtgcggttatcgaatctgagaacagcgcagagcgcgatcagctgctggaaaacctgcaggaaggcatggaagttaaaggtatcgttaagaaccttactgactacggtgcattcgttgatctgggcggcgttgatggcctgctgcacatcactgatatggcctggaagcgcgttaagcatccaagcgaaatcgtgaatgttggcgatgaaatcaacgttaaagtgctgaaattcgaccgcgagcgtacccgtgtatcactgggtctgaagcagctgggcgaagatccatgggtggctatcgctaagcgctatccagaaggcactaagctgactggtcgtgtaaccaacctgactgattacggctgcttcgtggaaatcgaagaaggcgttgaaggtctggtacacgtttcagaaatggactggaccaacaaaaacatccatccgtctaaagttgtaaacgtaggcgatgtggttgaagttatggttctggacatcgatgaagagcgtcgtcgtatctccctgggtctgaagcagtgcaaatctaacccatggcagcagttcgccgagacccacaacaaaggcgatcgcgttgaaggtaaaatcaagtcaatcactgacttcggtatcttcatcggcctggacggcggcatcgacggtctggttcacctgtctgacatctcctggaacgcgactggcgaagaagccgttcgtgagtacaaaaaaggcgacgaaatcgctgccgttgtactgcaggttgatgcagagcgcgagcgtatctctctgggcgtgaaacagctggcagaagatccgttcaacaactacatcactttgaacaagaaaggtgccatcgtcaccggtaaagtgactgcagttgatgctaaaggtgctacagttgaattagcagacggcgttgagggttacctgcgcgcttctgaagcttcactggaccgcatcgaagacgctacgctggttctgaacgtaggcgacgacgttgaagctaaattcaccggcgttgaccgtaaaaaccgcgttgttagcctgtctgttcgtgcgaaagaccaggctgacgagaaagaagccatcaacactgttaacaccaaacaggaagaaggcaacttctctagcgctatggctgaagcgttcaaagcggctaaaggcgagtaatcgaccttgcaccgggcggatttattcgcccggtttcggtaaaagctgtcatacattcctgtagggattaaccggaggttacatgaccaagtcagaactgattgaaaggctggcgggacagcacactcatataccggcgaaagtcgttgaggatgcagtcaaagagatgcttgagcacatggccactacgctggcacagggcgaacgcattgaaatccggggattcggcagcttttcgttgcattatcgcgctccgcgcactggccgtaacccgaaaacgggtgacaaagtggatctggaaggtaaatacgttccccacttcaagccaggtaaagagctgcgtgatcgtgccaacatttacggctaagccgataccgaaccgcctaaacgacatctccggatgtcgttttttttgcctgattttgacactgaacctctcttccagaaaaaagccgcacgactgcaaccgccgatattcacttcgacgcttccctcatttcgcccatagcctgctttatcaagaatagctctgcggcatactcgcgctacgacaagagcgagatgcattatgttgacatggattgcactggcaagaatcgctgcggtgagcagtttacctttactgctattaccccggcttccgccgccgttattaacggtgctgttgctcctgagtggcggttgcctgatgcagttgcctcaccgctacgtgcgtatgacaggcgtgacgctgctgctcgctgcatggtcgcttttcaatgcacaatctctggtaaacgacaccgaaaagatgattgcccggccagcgatgttcgatgtgcaaattgaggatgtacatcagacccattcccgcatcagagtcagactgctcaaagagggcaaccagaggtttttcccacctcgctttgcctggctctcgttgccgggtgacagcagtgaatattgcccgggtcagcgctggaaaatgatgctcaggctgagggcggtgcatgcccggctcaacgaaggcgattttgatgcacagcgtttcgccatggcgaaccatgcacctgtacaaggacgcattatttcgcaggtcatcacgcatccatcctgcagctggcgctggcgttttatacattatcatcgccagcaaaacggtttgttgcctgcctccgccacgcttgaagcactggcgtttggtatccgggacaacctgagtgaagctacccggcaattattgcgtgacacgggcaccgtacatttgatggctatttcaggcatgcacatcgcgctggcagcaggaacgggatggttactggcacggggtagccagattctgtttccggcccgccgtattggttatcggtatcccgtggtcattagctggatttttgccgcgctgtatacctggctctcgggggctcatgcacctgcgcagcgggcattgctggcactgactctctgggccgtaacacgattcattggcgtgcagttaagtagctggcaagtctggacgctgtgcgtaggttcactgctggctatcgatccgctgacggtgctctcggacagcttctggctctcggtgctggccgttggcatgttgttgacctggtatcactggtttccactggcggcgcgctttcgccacgcacgccgctggttgccaatacagctcctccacctgcagttggggatgatgattttgatgctgccgctacaggcgagtttatttaatggcatcagtatgacggcgctaatcgcgaatctgctggccatcccggtggtgtcattcatcacggtgccgttgatactgcttgcgatgctgctgccggtagcggaattatccatgtggctttggctggcggcagatgtgtcgcttcgtcttctgttaaccggcctggctctgttgccgccaggctggtggccgctacaaggggcgacgtttttatatgctcatcgtctggggcggtctgcttgtctggcgcactggcgtactattcagcctgccgtggagctgcagtgctgtcgcactggccctggtgttctcccgccacgataaaccggacagggaatggcgcattgatatgctggatgtcgggcatggtttgagcgtggtaatcagtcagggccgtgaggctgtgttgtacgatacggggccgcgctggcaaaacagtgatgcgggaacacggattattattccctggatgcaacgcaaaggtcttaaattgcagcaggtcatactgagccacaagcacctcgatcacaccggtgggttatctgccattctgcaacactggcccacaatgaaggtccgcagcggtttaacgggccaccagcatttaccctgcgttcgcggtgccgcatggcgctggaaacagctaaattttacggtgctctggccgctcaccgcgccgaacgcgggcgaaaataacgactcctgcgtggtgagggtggatgatggaaaagtccggctgttattaaccggcgatcttgaaagcccggctgaaaagcaactggtcaggctggaaaagcagcagcttaaggctgatatcctgcaggttcctcaccatggcagccgtacctcgtcgtctcgcttactgctgcgcagcgtcgccggtagcaccgcgatggcgtcgctggcacgctataatgcatggcgcatgccggcgaaacctgtgttgcggcattaccatgaatatggctatgactggctcgatacggggcaatccggacagataagcatcagggttaataagggaaaaatacaggtttttaccctcagagagcaattaatgccccgttggtatcatcagtggtttggcgtcaaacgcgaatccaggtagaatgaccggctatttccaacaacgtgaataaataatgcatcaagataaagatctctcaacgtggcagacattccgtcgactctggccgatgatcgcacccaacaaagctggcttaattgtggcggctacggccctgattattaatgccgcaggcgatacgttaatgctctccctgttgaagcctttgctggatgacggcttcggtaaagcggacaggtccgtaatgctgtggatgccgttggcagtcattggcttgatgctgattcgtggcgtgagcagctatatctccagctactgcatttcatgggtgtcgggcaatgtagtcatgaatatgcgtcgccgcctcttcagtcatatgatgggcatgccggtagccttcttcgatcaacagtccacgggcacgctactctcgcgcatcacctatgattctgagcaggttgcctcgtcgtcgtcaggtgcgctggtgacggtggtacgtgagggtgcatcgattattggcctgtttatcatgatgttttattacagctggcagctgtcactgatcctgattgtgctggcccccatcgtttcatttgccattcgcatggtgtcaaaacgtttccgtaacatcagcaaatcgatgcaaaacaccatggggcaggtgacgaccagcgctgagcaaatgctgaaagggcataaagaagtgctgattttcggtggtcaggaaattgaatctgagcgctttgctaaggtcagcaaccgtatgcgccagcagggcatgaagctggtttcagcgtcttcgatctccgatcctgtcattcagctgatcgcctctctggccctggccttcgtcctctatgcggcaagtttcccaagcgtaatggatacgttgaccgccggtaccataacggttgtgttctcctcgatgatagccctgatgcgcccactgaagtcgctgactaacgtcaatgctcagttccagcgcggtatggcagcctgccagacgctgttctcaatcctggacagcgaacaggaaattgacaccggtaagcgtgaaattacccgcgccaaaggcgatgtcgagttccgtaatgtgacatttacctatcccggtcgtgaaaccccagcattgaaagacattaatctgatgctgccagcaggaaaaacggtggcattggttggtcgctcaggctcgggtaaatccaccattgcaagcctgctgacgcgtttttatgatattcagcagggcgacattttgctggatggtcacgacctgcgcgagtacaccttatcctcattacgtaatcaggtggcactggtgtcgcaaaatgtgcacctgttcaatgataccgtcgccaataacatcgcctacgcgcgaagcgagcagtacagccgcgcggaaattgaaaaggcggcgaccatggcccatgccatggattttatcaataaaatggataaaggcctggataccgtgatcggtgagaacggcgtgctgttgtctggcggtcagcgccagcgtatcgctattgctcgcgcgctgctgcgcgactgcccaatcctgattcttgatgaggcgacctctgcactggatacggaatctgagcgtgccatccagtcggcgctggacgagttacagaaaaaccgtacctccctggtcattgcacaccgcctgtctactatcgaaaaagcggatgaaattgtggtggtggaagagggcaaaatcattgagcgcggcacgcatgcagcgttgctggcggaaaaaggcgcttatgcacaacttcataaaatgcaatttggccaatgattgagcgcatctggagtggccgatcgcccctgtggttactgctatggccactcagtgtgctgtacggtgctatcacggcattgattcgcttcagttttcaacgcggctggcgtaaaagctggcgcgcgccgctgcctgtggtcgtggtgggcaatttgactgctggtgggaacggtaaaacgccagtggtgatttggttggtagaagccctgcaaaagcgcggattacgggtgggtgtgatttcgcgcggctatggcggcaaagcagacagttatccgttgcgggttacggctgacactgcgaccgaacaggcaggggatgaacctgttctgatcgctcagcgcacgtctgcgccagtggccgtcgcccctcgtcgtcgtgatgccattgaggcgctcctggaacatcactcactggatttgattgtcaccgacgatggcctgcagcattacgcattgcagcgcgatcgggaaatcgtggtggtcgatggtgtgcgccgttttggtaatggctggtggctacccgcgggtccgatgcgtgaacgtgcttcgcgcctgaatacggtagatgccattatcgtcaacggcggcgaaccgcagcagggtgaaattgccatgcaactgcgcccgggcatggcgatccaccttcttagcggtgagcaacgtccactcagcgcgtttcatgacgttgtcgcgatggcgggaatcgggcatccacctcgcttttttaacaccttaaaacagcagggtttaacgcccgtggcggaaatcgccttcgccgatcaccatgcctatagtgaagacgaactttcacgtctgctgctgcctgagcagacgctgctgatgaccgaaaaagatgcggtaaagtgtcgcgcattcgcgcaacctgcctggtggtatttaccggtagatgcccatctgccagctgaagcggcaacggtactgttagacgatttagaacgcctttgcggcacgtattcacaccgggcatcgcactaaaatccccttcagataaggaagagaatgagcacacattcactttcgctacagcaggcccgcaatattcaactcgcggcgcagggcctgcttcgtcccgctgcccgccgggcacgccgtgaggacattccagactgcattacccagatgtctttgctgcaaatcgacaccatcaatgtagttgcccgaagcccttatctggtgctgtttagtcgtttaggcgactatccgccctcctggctggatgaggctcttgctcagggcgagatatttgagtactgggcccatgaagcctgctttattccgcgcaacgattacaaactactgcggcatcgcatgctgtcgcccgaacgtctgggctggaaatacagtgcgcagtgggctgccgaatatcagcaggagatcgccgagttactgacgtatatccgcgataacggaccggtaagatcggccgattttgccagcggaaaaaatcataaacccggatggtgggcctggaaaccgcacaagcggcatcttgaaaacctgtttagtgccggtgagttgatggtgtcggaacggcgaaattttcagcgtgtctacgatttacgcgcccgggtgatgcctgactggcaggatgcgatccatgccatcagcgaggacgaagcaacccgattaatgcttataaacagcgcacgcagcctggggatttttcgccgtgagtggctggcggattattaccggctgaaacgtgcacccgtcaacgtgtttatgcaatgggcgcaggaggccggagaaattattccggtcgaggttaacggcatgggagaaatgtggctgcatcagagtgcgctgcccggattagcgacgccgttgaaagcgacacataccacgctgttatccccgttcgatcccctggtttgggatcggaaacgggcgctggaactctttggttttgactaccgtattgaatgctatacgccagccgctaagcgtaaatatggctactttgtcttacccttgctgcatcgcggccaaattaaagcccggcttgatgcacggatgctccgcgcatcgcgccagcttgaaatcaaaaatatctggctggaacaaaacgtcccgctcactgcggcatttttgcaggatgcccaacgcgcaataacccgctttgcgcgctggcagggcgcagagacggtcgcgattcagcaggcaccctcagcgttactggcgcactggccaacgttgtggcaactggataatccgtgatgccgcacccggtgcggtttacccgctcttgtcagtgctgtgatatgctttagcgcttacgctctcggtccgtgatggaggaaatatggatcaccgtttactcgaaatcgttgcctgcccggtttgcaatggcaagctgtactacaacaacgaacagcaagaactgatctgcaagccggatgcgctggctttccctgtgcgcgatggcattccggttctcctggaaaatgaagcccgtaccttatcggttgaagagatccatccatgagttttattgccatcattcctgctcgttatgcctcaacccgtttacccggtaaacccttggtcgatattcatggcaagccgatggtggtacatgtgatggagcgtgcacgagaatccggtgccagccgggtgatcgtggcgaccgaccaccctgatgtagccagcgctgtcgaagcggcagggggcgaagtctgcatgacgcgcgccgaccatcattcaggcacggaacgtcttgccgaggtgattgagaagtatcagtttgcagacgatcaaattatcgtcaatgttcagggcgatgagcccatgatcccggcggaaatcgtgcatcaggtagcgaccaacctggcgcattctgaagcaggtatggcgacgctggccgtgccgattaccgatgcggaagaagcatttaatcccaatgccgttaaagtcgttatggatgcaaaaggctacgcgctgtatttctcacgcgcgaccattccctgggaccgtgagcgctatgctgaatcgcgcgatcggatcggcgatacgctgttacgtcacattggcatttacgcctaccgcgcagggtttattcgtcgttacgtaggctgggcaccttgtccacttgagcagatcgaacttctcgagcaactccgcgtgctgtggtatggcgaaaagattcatgtcgcggtagcaaaaacggtaccgggcgttggcgtcgatacgccagaggatctgatccgcgttcgtgctgccatgcacggctgagtcgagccgtcgcgctttaccccgcgcggcgcttgcctgaggatgcacctgtccagatatggccccaaacagaaaaccatggttgagggatacgcgcgttatggggcgtatcactcagcatgtttacgcgcctgtgccctcagcggaggttttaaagcgctgtaacaggctgcccagcgtttcatagatagcgcgctcgctgtggcccatccacagaggagaagggaaagcacgctcccaccagtttaacggggaggtaatcgccagttggttagccggcgcgggcgtcgggtcgagtcctgcctgctggaaaaaacgcatggcacgcggcatatgattcgctgatgtgaccaacaggaagggttgatgaccgatcagggcgctgaccgcctgggcttcctgcgcagtatctttgggctgatccaacgtatggatatgtgatgaaggtacgccaaggctttcggcgacctgtgcggccacccatgcattacttttggggttatgccctgcagcggcaccggtaaatatcattgttgcctgcgggttacgccgccactggcgcacgccttctgtcacccggggcaaactgttattcaacaagtttgaactgggtgcccatgcagagttataggtataacctccgcccagtaccacgatgtaatccactttctggctgccattccaggtcggatagtgcgactccaccggcagcagcaggcggtctgcaacgggttgtaggctaatcagcaataacaccagccagctggttgagatgattattttgccgcttttctgccagcgactgaaccaaagcagtaaaatgcccactgccataagtaaaagcagaaaaggcaggggaagtaatacgttacccactgcctttttcagcataaaaaacatttaaaaaacctcttgttgtccgaaaaaacagcagccagagcacaagaatgggatgaaagcttcattcttactgtacctgtgacaaaatagcatatgtttcaccgcagcataccggagtccacgccatgcaggatcgtaactttgacgatctcgcggataaattttcgcaaaatatttacggcacaaccaaaggccaggtgcgtcaggccatcctgtgggatgagctggaaacgattcttcccagcctgtcctcctcttccctgagcgtgctggatgcgggcggcggtatagggcaaatttccagcgggctggcggcgcggggccatcaggtcgtgctgtgcgatctgtcaggtgaaatgttacgccgcgcgcaggaaaatgcacaggcgctgggtgtgagccaccacatgcaattcaaacaaattagcgcgcagcaggtcggtgaacatttggttaagccggtggatctggtattgtttcacgctgtgcttgagtgggttgctgaacctgaagccgtgttaaaagccttgtttgatacactgcggcccggcggcgtgctgtcgttgatgttttacaacctgcatggtttaacattacgcaccctgacgttgggcaattttggctatctgcgtaccaacttaaccaaacgcaagaagcgcacgctgtcaccggattatcctcgcgatcccgatgatgtgtatcgctggctggaagcctgtggtttccagattgaacggcgtgccgggattcgtgtattcagcgattatatgaagccgcctaaaggcgagccgaagagtgacgacgaaattattgagatggagcggcgcttttgccgccaggaaccctttttaagcttagggcgttacatccacgtgaccgcgcgcaaacccgggcagaaggacgaattatgagtgaattttcccagacggtaccggaactggtatcctgggcgcgcaagaatgacttctcccttgcgctgccagttgaacgtctggcttttttgctggctatcgccacgctaaatggcgagcgcatggacggagagatgagcgaaggtgatctgattgatgcgtttcgtcacgtcagcaaagcctttgagcaaaccagtgaaaccgtcctggtgcgtgccaacaacgccatcaacgatatggtgcgtcagcgcttgttaaatcgctttaccagtgagttaaccgagggcaatgccatttatcgcctgacgccgttggccatcggcatcaccgattactatatccgccagcgtgagttctccacgctgcgtctgtctatgcaactttccattgttgctgcggaactgaagcgtgccgcggatgccgctcaggaaaatggcgacgaatttcactggcaccgcaacgtgttcgcgccgctgaaatactcggtggccgaaatcttcgacagcattgatatgacacagcgcctgatggatgagcaacagcaggcggtgaaatccgatattgctgaactgctgaacaaagactggcgagccgcaatttcaagctgtgaaatgttgctgtcggaaacctcaggtacactgcgcgagctgcaggatacgcttgaggcggcgggcgacaagctgcaggaaaatctgctgcgtattcaggatgcgacgctggatagcccggatctgggcttcgtcgataaactggtcttcgatttgcaaagtaaactcgaccgcattaccagttgggggcagcaggccatcgacctgtggattggctacgatcgccacgtccacaaatttattcgtactgccatcgatatggacaaaaaccgcgtttttgctcagcggttgcgggtttccgtacagaactattttgatgcgccctgggcgttgacctatgccaacgccgaacgtctttacgatatgcgtgatgacgaattgacgctgcgtaatgacgaagtcatgggcgaactgcctgccgagctggaatttgaagaatttaatgaaattcgcgagcagctggcggccatgattgaagaagccttagagagttacaaaacgcagcaaaaaccgctcaacctcgccgtggtaatgcgcgactatctggcccaatacccacgcgcgcgtcactttgaccttgcgcgcatcgtagtggatcaggcggtgcgactcggcgtagcggaagccgatttagccggtttgcctgtggaatggcaagccattaatgattacggagccaaggtgcaggcacatgtcatcgacaaatattgaacaagtgatgccggttaaactggcacaggcactggcaaatccgatttttccggcgctggacagtcagttgcgtgccggacgccacattggcattgaagagctggataaccacgcttttctgatggattaccagcagtatctggaagagttttatacgcgctataacgttgagctgatccgcgcgccagagggattcttctatctgcgtccacgctcaaccacgttgattcctcgctctgtcctgtctgagctggatatgatggtcggtaaaatcctgtgctatctctatctcagcccggaacgtctggcgaacgaaggtatttttacccagcaggagctgtatgacgagctgctgtccctggctgatgaaagcaaactgctgaagctggttaaccagcgctcaaccggctcggatctcgatcgtgccaagctgcaggaaaaaatgcgggcttccttaagccgcctgcgtcgtcttggtatggtgtggttctttggcaatgacagcagcaagtttcgtattatcgagtctgtttttcgctttggtgccgatgtgcgcagcggtgatgatccgcgggaagcgcagttgcgcctgattcgtgacggcgaggcaatgttgctggacaacgcaacggccacgactgaggcagaagacagtgaagagaatgacagcgatgcgggtgatatcgcggaggaagaacaggcatgattgaacgcggcaaatttcgttcgctaacgctgatcaactggaacggtttctttgcccgaacctttgatcttgatgaactggtcaccacgctgtcgggtgggaacggggcaggtaagtcaaccaccatggcggcctttgtcacggcgctgattcctgacttaaccttgttgcacttccgtaacactaccgaagccggcgccacctcgggttcacgcgataaaggcctgcacggtaaacttcgcgccggcgtctgctatgccatgctggacgtagtcaattcccgtcatcaacgcgttgtcgtgggtgtcagactgcagcagatcgccggacgtgataagaaggtcgatatcaagcctttcagtattcatgggctgcccacggatacgctgcctaccgatatgctcacggaaatccttaacagccgtcaggcacgtgttttaccgcttaacgaggtaaaagaacgcgttgaggcactggaaggcgtccagttccgtcagtacagctcggtcaccgactatcatgccatgatgtttgatctcggtgtcgtgccgcgtcgcctgcgttcagccagcgatcgcagcaagttttatcgcctgatcgaagcgtcactttacggcggtatctccagtgcgattacccgctctctgcgcgattacctgttgccggaaaacagcggcgtgcgcaaagcgtttcaggatatggaagcggcactgcgcgaaaaccgcatgacgctggaagccatccgcgtgacgcagtccgatcgtgacctgttcaagcatctgatttctgaagccaccagctacgtttcggcagactacatgcgtcacgccaatgagcgacgcattcatcttgacagcgccttacaactgcgcaatgagctgttcagcagccgcaaacagctggcctctgaacagttccgtcatgtggaaatggcgcgtgagctggccgaacacagcggggcggaaagcgatctcgaaatcgattatcaggcagccagcgatcacctgaatctggtgcaaacggcgatgcgccagcaagagaagattacccggtatgacagcgatatcgaggatcttacgctgcgtctggaagagcagagcgaagtggttgccgaagcgcgtgaaatccaggaagaaaatgaggcccgcgccgaggcggccgaactggaagtcgatgagctgaaaagtcagttggccgattttcagcaggcgctggatgtgcaacaaacccgggcgatccagtaccaacaggcattacaggcgctggaacgtgcgcgatcgctgtgccagttgccggatctgaatattgaaaatgctgccgaatggcaggccagcttccaggcgaaagaagaagaagccacggggcaactgttgcatcttgagcagaagctgagcgtagcggaagcggctcacagccagtttgagcaggcgttgtcgctggtcaccagcattgccggtgacgtcagccgcaaagaggcgtggcaagtcggccgcgacctgctgcgcgatgccagcaatcagcgtcaccatgccgatcaactttcgtcactgcgtctgcgcctgaatgagcttgaacagcgcctgcgcgaacaacaggaagccgaacgtctgctggcagagttctgtaaacgtcagggccagcattacgagcctgatgcgttggaaggtttgcagcgtgaactcgaagcgcaaatcgagcagctcaacagcagcgtggctgacgcgggcgaacagcgcatgatgatgcgccaggaacttgagcagctgcgcgaacgcatcacgtcgctgaccgcgcgcgcgccgcactggctggcagcacaagaaatcctgactcagctcagtgagcaaaccggtcaggaactggccagcagccaggacgtgaccgaatacatgcagcagttgctggaacgcgagcgtgaaaccaccgttgaacgtgacgaagtggcggcgcgcaaacgtgaaattgagcagcaaattgaacgtctcagccagccgggcggtgccgaagatccccgtctgaatcagcttgccgaacggtttggcggcgtactgctgtcagaaatttatgatgacgtgacgctgaacgatgcaccttacttctccgcgctgtatggcccgtcgcgccacgccattgtggtgcccgacctgtcgctggtgcgcgagcaactggatggcttagaagagtgcccggaagatctgtacctgattgaaggggacccccagtcgttcgatgacagcgtgttcagcgtagacgagctacaaaacgcggtcgtggtgaaagttgccgagcgtcagtggcgctattcccgcttcccaaaaattcctttatttggtcgggcggcacgcgaaaaccaactcgagctgcttaacaatgagcgcgatcgcctggcggaacgctatgccacgttatcttttgacgttcagaagacgcaacgtttacaccagtctttcagccgctttatcggcagtcaccttgcggtggccttcgatgacgatcctgaagcgcaaatccgtcagctcggcgcccgtcgcggtgagctggaacgtgcgctcaatcaacatgaaagcaacaatcagcagcagcgtcagcagtttgagctggccaaagagggcgtcgcacagcttaaccgcctgttgccgcgcattaacctgttgctggatgagaccctggcggatcgttgtgaagagattcgcgagcaggtcgaagaggcgcaggaagccgcacgtttcctgcatttacatgggacgaaactggccaaacttgagccgatgattgcggtactgcaaagcgatcctgaacagcacgaacagctgcaggcggattaccagcaggcgcagcaacagcagcgcaatgcgcgtcagcaggcgtttgccctgacggaagtggtacagcgccgggcgcattttagttatgacgattcggctggcatgctgggcggcaacaacgacctgagcgataaactgcggcagcggctggagcaggccgaagccgaacggagccgcacgcgtgaacgtctgcgcgcgcatcagtcgcagctgacgcagtattcgcaggtgctggcatcgttaaaaagtgcttatgatgccaagcgcgacatgctgaaagagctgcagcaggaaatgcaggacattggggttcaggccgatgccagtgcggaagaacgcgcgcgaatccgccgtgacgagctttatacggcgctgagccacaaccgcgcccgccgcaatcagctggagaaacagctcaccttctgcgaagcagagatggacaacctgcagaaaaagctgcgccagcttgaacgtaactatcaccagaaccgtgaacaggtggtcagcgccaaagcgggctggtgcctggtactgcgtctggttaaagacaacggggtggaacgccgtctgcatcgccgtgaactggcttatctcagtggcgatgaactgcgctccatgtcggataaggcactgggcgcactgcgcctggcggttgcggataacgaacatctgcgcgacgtgctgcgtttgtctgaagatcctaaacgtccggaacgtaagattcagtttttcatcgccgtgtatcaacatctgcgcgaacgtatccgtcaggatattattcgcaccgacgatccggttgaagccatcgaacagatggagattgaactcaatcggctgacggaggagttgacggcccgtgagcaaactctggcgatcagttcacgcagcgtggcgaatattattcgtaaaacgattcagcgtgaacagaaccgtattcgtcagctgaaccaggggttacaaaccgttagctttggtcaggtgcgcagcgttcggcttaacgttaacgtgcgggaaacccacgcgatgctgttggatacgttgtctgaagagcatgaacagcatcaggatctgtttaacagcaaccgactcacgttctcggaagcgctggcgaagctctatcaacgtctgaatccgcatattgatatgggccagcgtacgccgcagaccattggtgaagagctgttggactaccgtaattacctggagatggaagtcgaggtcaatcgtggttcggacggctggctgcgcgcagaaagtggtgcgctgtctaccggtgaggcgattggtaccgggatgtcgattctggttatggtcgttcagagctgggaagaggaatcacgccgcctgcgtggtaaagatatttcaccttgccgtctgctgttcctggatgaagccgcacgtctggatgcacgctctatcgcgacgctgtttgaactctgtgagcgtctggagatgcagctggttattgcggcacctgagaatatcagcccggagaagggcaccacttataaactgatgcgtaaagtatttaataataccgagcacgttcacgtggtgggattacgcggattcgccgccgatccgctgcctgcgaaacgcagtagcgaagccgatccagcaagcgaaaccacgacataatattcatgatgcagagatagtcaaaaacagcgccattggttaatctggtaacggcatttgtcacaggaggcaaatgccgtttttattcgtatactcaataatatgggtaacagcccgatcgcagccgtttcctgacatgctgcgcggtagattaatgaagggggcagggatgttactgaataaaagcttaaaaattcatcaggttagttcgtggcttgcgctggcactaacgctgattccttgtgccatggctcaggccgctatcatcgctgccatgccgggcacgcaaatgacgcatgcagccctgtccgtcagcgagagccagcagaagatccgacaggctttttcaggcgataaccaacctttttatggcgcttcactggctgccctgtatgccgcgcgaaatatgcagccgatctggcaagatcctgacgccgtgcaaaagtttcagcagcagctggcggaagttgcgctttccggcgtccagccgcagtttacccgctgggtcgatcgcctgaccgatccgactattacagatttcgcccgcgatgtaacgctgtccgatgcgatgctgggctatttgcagtttgtgtcaacggtgcctgttcagggggaaacctggctgtacagcaccgtcccttacaagctggcggtaccgtcggtgtccgtgatcaatgcatggcagaatgcggtgaatgcgggcagttcgctggcctttgtcaattcactggtgccgcagcatccgcagtatcctttgatgcacaaggcgctgaagagtctgcttgaagataaacagccctggccgcaaattaaaaatcgtgacaccttacgacctggacaggtcagtgacgatgtgccggccttacgcgaaatattacgccgcagcggtatgttaagcgctcaggttgccgtacctgcgcccaacgaggatgccgttcccaccgcgcccgttcctgccagccacagcgagcagcctgtcgccgtgagtccttcggcagtgacggttaatgatatacccgccaccacgcccgatgtttcaggcaatgtgcaaaatgcccccgcggcaccgggcggtgtgaacgtctatgatgacaacctggtggcggcggtaaaacgctttcagcagtggcagggacttgacgccgatggggcgattggcctgcgcacacgtgaatggctgaatgtctcaccccagcagcgtgctgctttactggcgttgaatattcagcgcctgcgcctgctgccggatgatatgcacaacggcattatggttaacatccccaactactcgctgaactattacagcaacggcacaaaagttctgtcctcccgggttatcgtgggccggccagatcgtaaaacgccgttgatgcgaagcgcactgaataatgtggtgctgaacccgccgtggaatgtgccgaccaacctggtgcgtcaggacattattcctaaggtgaaacaggaccccacctatctgtataagcacggttataccctgctgtctggctggagtgccgattctgaagtcatcgatcccagcatgattgactggagcatggtgtccgcgtcttctttcccttaccgcatacgtcaggcacctggtcaaaccaactcgctgggtcgctataagtttaatatgccaagctcggatgcgatttatctgcatgatacgccgaaccacaacctgttccagcgcgatattcgtgcgctaagctcgggctgcgtgcgcgtcaataaagcctcagaactggcgggtattctgttgcaggatgtcggctggaacgatgcccgtatctctgacacgcttaagcagggtgacacgcgctatgtgcctattcgccatcgcatcccggttaacctgtattatttaacggcctgggtcgcggatgacggtaaaacgcagttccgtacagatatttacaattatgataatacggcgcgttcagccagccaggtcttaagccgtgcgcaacagttgttgctctaatggttgatttttaatcgttagtcgcacggcctctgtgtgattcagtcctgtcattaaggcggctttatctggagccgccttccaaacttgcccataatgggttgacgtgctagcgccaggaagttatggttccgccagtacgttttttgcacatgtctttgactctgttttcaggtaaaccgctccatgtctacaatcgattctttacgtcgcaaactgctgctttgcggaagtgccgctgccggtctggccttactgccagagaccgcgatggcttcactgtccacttcacgtccacggattttaacgctcaataatcttcacactggtgaaacccttaaaactgaattttttaacggtaaaagttacgacaaaagtgaattgtcacgcctgaaccactttttccgcgactaccgtgccaataaaacaaaaagtatcgatccccatctgtttgaccagctctatcgtcttcaggcgctgttggaaacgcgcaaacccgttcagctcgtctccggttatcgctcactggcgacgaacaatatgctgcgggaatcgggacctggtgtggcaaaacacagttaccacaccaaaggccaggcgatggattttcatattgaaggggtgacgttggcgaatgttcgcaaagccgcattaaaaatgcgagccggtggtgtaggatattaccccagcagcaactttgtacatattgataccggtcccgtcaggcactggtagtaacgtcggcaacgctgcgggtgccgaccatggagcgttatgaactatcacattatccccgtcaccgcctttgcgcagaattgttcggttatctggtgtgaaaccacgcgtgaatccgcccttgtggaccccggtggcgatgctgagaccatcaagcaaacgctggcacagcttgctgtaaagcccgcacagatcctgctcacgcatggtcatctcgatcacgttggggcggcggcggaactggctgcattctggaaggtgccgctggtcggtccgcaaaagcaggatgcattctggctggaatcattacccacgcaaagccaaatgtttggtcttgagtactgcgcgccactgacgccggatcgctggctggaggaaggtgacactgttcaggtcggccaggtcacgcttgacgtactgcactgcccgggacatacgccaggccacattgtattttttgatgccaaaggtcgcttactgatttcgggtgatgtgatttttagcggtggtgtagggcgcactgatttcccgcagggcaatcatcagcatctcatcgatgcgataaaaaataagctgctgccgctaggcgacgatgtcacgtttttacccggtcacggtcctgtgtcaacgctgggacgtgaacgtctgaccaatcctttcctgcaataaaaaatgggccagagcggcccattttttatgcggtatcagcctaaagtacggcgacaattgcctcacacagtgcagacatattatctggcgtcataccggcaacgttcacgcggcccgaattaacggcataaaccccaaactcctcgcgcaggcggatgacctgatctttggtcagtccgctgaatgagaacatcccattctgcttgatgataaagctgaagtcctgctgtgcgcctttatccgccagcgtgttcacaaacagctgacgcatgcgctggatacgctgacgcatatcggacagctcttgctgccagatagtacgcagcgcgtcattacccaggatggtggcaacgacggcggcaccgtgtgacggaggattagagtagttagcgcgaatagtgtatttcacctggctaaacgcggtctcgaccgtcgcggcgtcgccggcaaccaatgtaatcgcaccaacacgttcgttatacaggccaaagttcttggaataagaactggcgacaatcagttcctgatggctggcagcaaaaatgcgcagcccttccgcatcctcttccagaccacgggcaaagccctggtaggcgaagtcgaacaggggcaaccagccgttggcctgggagagctgtgccagctgttgccactgctctgctgttgggtcaataccggtcgggttatggcagcagccgtggaacagcaccacatcaccagctttcacctctctcagcgaggccagcatgccgtcaaagtccagcgtatggttagccgcgtcgtaatactggtattcgcatacctcaagcccggcggcattgaacacgtttttgtggtttggccagctcgggttgctcacccacacgcgcttaacggcggtctgggtggacaggaaatctgcggcgacgcgcagtgcacccgtaccgcccggcgtctgcgccgtacgggctcttcccgacgcgatcagggcgttgcctttgccaaataacaattcctgcgtgcaacgcgcgaaatccggcagaccgtcaatgctcagataatttttgctggtttcgttttcaagcaggtactgttctgcttttttaacgctggtaagcaccggcgttttcccggtttcatctttataaacaccaataccaagattgattttatttgggcggtcgtcggcacggtagagatcggccaggccaaggataggatcagcgggtgcagcagagatcgattcaaacatgagtcgggtccagtagcgtgaactttagcaaatgaaccatcaggttaacgtcagcacggcgaaatgccaaccgtttgcgataaaattcatcgtctgtgcgccagaattacccgttcttatgttgtcggggggaaataaccggggagagggcgagaaaacggcattaaaaaacggagccgaagctccgttttttgtactgcatcaacaaacttagaactggtaaaccacaccaacaccaactacgtcatcgttaggaatgccgagtgggttgtttttgtccagctggttgattttgtaatcaacgtaggtggccatgtttttgttgaagtagtaagttgcgcccacatcgaagtatttgtagatatcagcatcgccgataccttcgatgtctttgcctttagactgaacgtaggccagtgaaggacgcagaccgaagtcgaactgatactgagctaccagctcgatttcttgagttttgttagcgaatgcattaccgctaaatgtcgtaccgttaacattaaacacacctttaattggtgttgagttacgggtttcaccgtacattgctgccaggtatacgttgttagcatcatatttcagagcagttgcccagttttctgcacgcttaccagcaccaacgccagcaccttgagaggttacaacgttgttattactgactgaaccgtcagcctggctattagtacgatcgctgctgctgtaagcacctacgataccgactccgatcggagaggtgtacgaggttgaaataccgtagccatcaccattcgcacggcgaggatcggtacgatcatttttaccctgatactgaagcgcaaagttccagccatctaccagaccaaagaagttggtgttgcggtaggtcagcagaccaccactacggccgttcatatagttgtctgagtaacctgagtcaccaccaaatactggcagcatatcggtccagccgattgcgtcataaaccacaccgtagttacggccgtagtcgattgaaccggcatcaccgaatttcagaccagcaaagcccagacgggttttgttgtcagtctgcgcgtcagaaccttcagagttattaccctgaatgttgtattcccactgaccgtaaccggtcatctggtcattaatcttggtttcgcctttgaagccaaagcgaatataagtctgatcgccgtcatcacctgcgttatcagagaactggtgacgcgcatccactttaccgtacaggtccagcttgttgccgtctttgttgtaaacttctgctgcgttagctgcgccggcggcgagcagagcagggataaccactgccagaatgttgcgcttcatcattatttattaccctcattggagttatttggacacctgccactgccgtcaagaaaactttacgtgaaccttgaaagaagtttggtgtctcctgtgtctgcacgcatctttccatcccccaccgggtaattctactgcgaaaatgctacaaaagtcgtaatcttgtttcaaatataaaatatgtattacaaaatgtaaaaataacggaactttgtgagacatatcaaaatttacaaaaataaaaaaaggccggcgatgccgacctctttatatatatgaatttcttatatttaatgctgaaaatcagaagctcgcgttgcgaggcgtgcgtgggaaggggataacatctcttacattttgtacgccggtgacataggcgattaaacgttcgaaacctaatccaaaacctgaatgtggcacggtgccatagcgacgcagatcacgataccaccagtaatcttcttttttcaggcccatctcttccagacgcgcatccagcacatccagacgctcttcacgctgagaacccccgatgatttcaccgatgcccggcgctaacacatccatcgcggccacggttttaccgtcgtcgttcaggcgcatatagaacgccttgatatctttcggatagtttttaaccaccaccggcgctttgaaatgcttctcggcaagataacgttcatgttcagaggacagatcgatgccccatgacacagggttctcaaaggtctgaccgcagttcatcaggatatcgacggcatcggtataatcgacctgggcgaaatcggtagtaacaaaacgctccaggcgattaatcgcatccttgtctacgcgttcggcaaaaaacgccatatcgtccgcacgctcattcagaacggcctggaagacatacttcagcatggcttccgccagggctgccgcatcgtctaatgaggcgaaagcgatttccggttccagcatccagaattctgccagatggcggctggtgttggaattttccgcgcggaaagtcgggccgaaggtgtagattttcgacagggcactggcgtaggtttcaccgtttaactgaccggacaccgtcaggaaggcttctttaccgaagaaatcctcggagtagtcgactttaccctgatcgttgcgcggtaagttttccatgtccagggttgagacgcggaacatctcaccggctccttcggtatcggaggcggtaataagcggcgtggagacccagaagtaaccgttctcatggaagaagcgatgcagcgcctgtgccagcgtgtgacgcacccgggctacagcgccaatcaggttggtacgcggacgcaggtgcgcgacttcacgcaggtattcaatactgtggcgttttgccgccatcgggtagctgtcgggatcttctacccagcccaccacttccagttttgtcgcctggatttcgaatgcctgaccctgacccggcgacgcaaccaccttaccggtgacaatgacggaacagccagtggtcaggtgcagcacttcgtcctgataattattcagagaattattgacgacagcctgaacgggattaaagcaggagccgtcatagacagcgataaaggaaagaccggctttggaatctcttcgggtacgcacccaaccacgtacggtgacgtcactgtcaaccgcgacgcgaccgtgcagtacatccgctacaggcactacgctcataaatatctctctatatagaagaagtgtgtgaatgaattccccagactggggtttagctatgttacttgtgagtcaacaggaaacaagcaaaattcaggggaatatcagatttaatgccaggaaggcggggcgcgttaacgccccgataacaaagaggctagctggcttttttaaccagcggcaggtcaaaggcttttcgcagggctttaacgaacgctttgtcctgacagatcgttttacctggactgtcagagagcttagcgaccggcttgccattacattgcaccagcttgatcacgatattgagtggcgtaacaccgggaatgtcgcaggtcaggcgcgtgccgatgccgaatacaacgttggtacgctggccaaaatgacgatagagcgccagcgatttctccaggttgagattatccgaaaacacgagcgttttcgtgagcggatcgatccccaactgctgatagtgcgccagggctttttcgccccactcaaccgggtcacctgagtcgtggcgcagtccctgataacgccgggcgaagaccggaccgaaatcgcgcaggaaggcatccatggcaatacagtcggtcaaagcaatgcccagcttgtcatcatattcatccagccaggcctgtaaggccgcgcgctggctgttcgccagcaccgggctgatttgctgaaaagcctgaaaccactcgtgagcctgagtacctactggcgtaagttcaaggcggcgtgccagatcatagttactggtgcccatcagccacggaaaatcctgtttcagggtgctgacaatcgattcctgaacgtcctgtgaataacggcgtcgggtgccaaaatccatcaatcggaaacgggacatatcggtgtcggccacctgggtttgaaacctgtccagtttctgatgcagaaattccacggcctgctggctgctgatggcgggtgtgcggtgacggtgaaccacttcgctgatcagcgccagcagtgggacttcccacaggatgacttcccgccaggggccctggatgcggatagccagcttgccatggtgattatggacttcgacctgttgtgggtcgtagcgaaagtttcgcagccagctaaggtagtcatcagcaaaaaagggcaggtcagataaccaggcatattcagcctcggtgagtgccagcgcctgcatggcatctattgccgcacggatctcgtcagcataaaaacccagcagctcgtcgctacggcagcggaactccgcggccaccgtgacatcatggtaacggtggaatacggcttgctgcatatgaagcttataagcatccgtatccagcagcgaagtcagtatcggggaagcatgtcctgtcatggcgcgtttcagcatcctgttcggtggcgcagagccctgtgtgtttaacgtcgtaaaagacgcaaaagtataaatcactaacagagagcgatcacagcatatttgaggatagcgagtcgaggacgaaatgtgtcattgttaacaaattgtagccattttatctgatacatgcattgtgcatgctaagctcggcgcatcatgcttagacgtttgacgagtaatgcttatacttttactttagcgacgaatgcgtagactttgacgaataactactacatgcgagacggaatatgacgcagcagccacaaataaaatatcgacacgattatcgtgcgccggactacaccatcaccgatatcgatttaacctttgaactggatgaaacgacgacgcgggtgacggcggtgagtcaggttaaacgtcagggagaccaccaggctgaactgcgtctggacggcgaagatctgacgctggtgtcgctggaagtcaatggtcaggcctggacagcctggcatgaagacgcgggttcgctggtattaagtcagttaccggacagcttcacgcttaaaatcgtcaatgatatccatcctgaccgtaacagcgcccttgaagggctctacaaatccggtgaagcgctctgcacacaatgtgaagccgaaggtttccgccatatcacctggtatctggatcgccccgacgtgctggcgcgctttaccaccaccattattgctgacggcagccgttatccctacctgctgtcaaacggcaaccgcattgacagcggtaaagatgaccagggccgtaactgggtaaagtggcaggatcctttccctaaaccttgctatctgtttgcactggtggcaggtgactttgatgtgctgcgtgacagctttaccacgcgttctggtcgcaatgttgcgctggagatctttgtcgatcgcggcaatctggatcgtgccgactgggcgatgacctccctgaagaacagcatgaagtgggatgaggagcgctttggcctggagtatgacctcgacatctttatgattgttgccgtggacttcttcaatatgggcgcgatggagaataaaggcctgaacgttttcaactccaaatacgtgctggcaaaagctgaaaccgccaccgataaagattatctggggattgaagcggtcattggtcatgagtatttccataactggaccggcaaccgcgtaacctgtcgcgactggttccaactgagcctgaaagagggcctgaccgtctttcgcgatcaggagttcagctccgacctcggatcgcgtgcggttaaccgcatagataacgtgcgcatcatgcgcggcgcgcagtttgccgaggacgccagcccaatggcgcatccgatccgcccggatcaggtgatcgaaatgaacaatttctacaccttaacggtgtatgaaaaaggctctgaagtgatccgcatgctgcacaccttgctgggtgaagagaatttccagaaagggatgcagctgtatttcgaacgccacgacggcagcgcagccacctgcgatgattttgttcaggctatggaagacgcttctaatatcgatctctctcagttccgtcgctggtacagtcagtcgggcacgccaacgctgtcggtgcgcgatgactacaacccggaactggaacagtacacgcttcatgttacccagcacacgccgccgacggccgagcagaaagagaagttgccactgcatatcccgctggatatcgaactctatgacgggcagggtaaggtgattccgcttcagcgtgacggccatccggtgcataacgtgttgaacgtaacggaagagttccagacctttgttttcgataatgtctatttccagccagtgccgtcactgctgcgtgagttttccgcgccggtgaagctcgattataagtggagcgatgcgcagctgactttcctgatgcgccatgcacgcaacgacttttcacgctgggatgccgcacaaagcctgttagccacttacctgcgcctcaacgtggcgcgtcatcagcaaggccagcatctgtcattgccactgcatgtcgcagacgccttccgcacggtgttgctggatgccgacagcgatccggcgctcaccgccctgattttatcgctgccaagtgaaaacgaaatcgccgagctgtttgaaattatcgatccgcaggccattgcgctggtgcgtgaggcgctggtgcgtacgctggcccgtgagctggccgatgagttctttgccgtttaccatgcgaatcagcaggccgaataccatgtagatcatgcagacattggtaaacgttcgctgaagaatatctgtctttactatctggccttcggggacatggacctggcgaataaactggtgcaggcgcaataccagcatgccaataacatgacggactccctggccgcactcaccgctgcggtggcggcacagttaccgtgccgtgatgcgttgttagcggactatgatgagcgctggcacaaggatggcctggtgatggacaaatggtttgtcttgcaggctaccagcccggcgcaaaatgcgttactcaacgtgcgtcgtttactgtcgcaccgttccttcagtatgggtaaccccaaccgtattcgctcgttgattggtgcgtttgcttcaggtaatccctcggcgttccatgccgaagatggcagtggttatcgcttcctggtggagatgttgacggatcttaatacccgcaatccgcaggtggcctcgcgtatgattgagccattgattcgtctgaaacgttatgacgctaaccgccaggcgctgatgcgtcaggcgctggagcagttgcaaggtctggataaactgtctggcgatctgtacgagaaaattaccaaggcactgaacgcctgataaaaaacggcgggttaacagcccgccgtttgattaacgctgttgcgcatagcgtggcggtttgtctgttgcgccgcgacgcataacccgatccagcacttccgcttccagctctgccagacgcgctgaaccccgtcgtcgggggcggggcagatcgaccagcaaatccagtcctatctgaccttcctctatcagtaacacccgatcagccatcgcgaccgcttcactgacatcatgggtaaccaacagaaccgtaaagtggtactgctgccagagcgattcgatcagctcctgcatctcgattcgcgttaaggcatccagcgcccccagcggctcatccagtagcagcaggccgggacggtgaatcagcgcccgagccagcgccacacgctgtttctgaccaccggagagcgcggcaggccactcgtgtgctctgtcagccagtccgactgcctccagcgcgtcacgtgcggcctcacgccatgcgttgccacgcagacccagcgagacattatcaatgacttttttccacggcagcagtcgggcatcctgaaacatcaaccgggtttcgtcgcgcgcagtctgcagtggcgcattacctgccagcagttggccctgggtgctgttttccagcccggccaacaggcgcagcagggtgcttttaccacagccgctgcggcccaccacggcaacaaactggccggaaggaatatgcaggtcgatgtgattcagaatggtgcgctcgccgtactttttactgacgccctttacaccgacgggcgtacccgcgttgagacgcgccgggatagcggagttaatcatgcggtttgctccttacgttgataagccggatgccagcgtaaccagacacgctccagcagtaatgcgctgacatcagccagttttcccagcagggcataaagaatgatggcaaccatcaccacatccgtttgcagaaattcacgggcgttcattgccagatagccaataccggcgttagccgaaatcgtctcggccacaatcagcgttagccacattaatcccagtccaaagcgcacgcctaccataatgctcggtaacgcgccgggtaagatcacctgaacaaacaggctccagccggataaaccgtagctgcgcgccatttcaaccaggcctgggtccacgttgcgaataccgtggtaggtattcaggtaaatagggaacagcgtgcccagcgccaccagaaaaattttggcggattcatcgatgccaaaccacaagataaccagtgggattagcgccagatggggcacgttgcgtaacatttgtagtgaggtatccagcaggcgctcacccagccgcgaggtgccggtgatcaatcccagcagcagaccgagggaaccgccaatgctgaagcctagcaatgcccgccaactgctgatggcgagatgctgccagagctcgccactggcggccaactgccagaaggtggtcacaatcttttccggtgctggcagaatacgcgtagacagccagccggtctgtgatgcaatttgccagaccaccaccagtaacaccggcagcagccagggcaccagcgccgctgagaatgatttacgtagtctggtcatcgttatctcctcaggcccgggcggcttttttctcaggcgtaaaatcattcgcaacggcttcaccgtgggcctgaatcacccgcggttgcgggacctgaggaatattcagatccagatgaggaaacagcagctcaccgacgcgataagcttcctccagatgcggatatcccgacaggataaaggtttcaatgcccagggcttcatactctttcatccgtgccgccacggtaggcgcatcgccaacgagcgccgtgcctgcgccactgcgcaccagcccgacgccggcccagaggttagggctgatctccagcttatcgcggcgtccgccgtgcagagcagccatgcgctgttgacccaccgagtcggtgcgttggaaggcgctttgtgctttggcgatggtggcatcatccacgttggcgatcagcttgtcggctgcctgccaggcttcctcattggtttcacgcacgatcacgtgaaggcgaataccaaaccgaacctgccgaccctgtgctgcggctttcgtccgcacttgctcaattttctctttaaccagggcaggtggttcaccccaggtgagataaacatcaacctgttcggcggcaagatcctgagcgggctctgaagaacccccgaaccacagcggcggacgaggctgctgtaccggcttaaacatcagacgagcgcctcgcacatgaacgtgcttgccttcgtaatccaccgtttcgccttccagcacgcgccgccagacgcgggtaaactcggccgattctgcatagcgctcgcggtgatcgagaaatacgccatcaccagccagctcctcgggatcgcccccggtcaccaggttgaacagcgcacgtccgttggaaaggcgatcgagcgttgcggcctgacgcgcagcctgggtgggcgaaatgacaccgggacgcagggccaccagaaaacgcagacgctgagtcacagggattaacgatgccgccaccagccaggcatcttcacaggagcgtcccgtcgggatcagaacgccaccaaagcccagccggtcggcagcctgtgccacctgttgtaaataagcatggtcaaccgggcgagcgccttcagctgtgccaaggtaatgtccgtcaccatgggttggcaggaaccaaaatacggaaacactcatttttctctccttattgcgtcacggcatggggatgccagatgcgctcggcaatcgatactttcacgggaatcagatgattggcataaaacagatcggcggttttctgctgcaaagcgaccgtttgcgcactcaccgggctgaccgggctgggcgggcgatggtccaggttgctggcaatgaccgcctcaggcagaccgatcgatgtagaaagcagatgaatactctgatcgcgttcgctacgcgtcagcgcttctgcgtcactgaaggcttttaacgtcgctaagacgaagtcattgtggtcctgtgcaaaactgcgtgtcgcaaggtagaacggcccggtttgattcagcgtggtgccgtctttcaatacgcggacattaccctgcagcaggacggcggaataataggggtcccatatcgcccaggcgtcaacgttaccctgctggaaggctgctcgggcatcagcaggcgtcagataaaccggctgaatatccttgaaactcagacccgcttcttccagcgcgcgcaatagcaagttatgggaactggagcctttctgaaaggccacctttttgcctttcaaatcggcaacggattttaacgggctgttttggctgaccagaataacctcagctttgggcttcggcggttcggagccgatatacagtaagtctgctcctgcggcctgtgcgaagatcggcgggatatcgccggtactgccaatatcgatgctgtccacgttcagcgcttccagcatttgcggtccggccggaaattcaatccactgaattgtcgtgtgggggaaacgcgtctccagcaggcgatgttcttttgccagcaccatactgaccgaccccttttgatagccgatgcgaacctgagcgggcggcgcttctgcggcgtcaacctgtgcccctgctacaaacatccctgccattaaccacgcgctgactattcgtttcatctctgtatccttacacggccagggcaacgggctgatgacgtcgtgacaacgccagccagaacgattgcaccgcttcgtccagacggcttgccagcaccgggtccagttctggctggcggtcgtaatgtttgatttgattatcttcggcgtaaaccccgtgaagcacttcttcagctttaagggcatttaaaactggcttaagcgcgtaatccagggccagcatatgaccggcgcttccaccactggccaacgggagcaccactttatgagccagcgcgcgttcaggtaacaggtcgagaacggtttttagcgcccccgaaaaagaggctttatagacaggcgtggcaatgaccaggccatcagcctgagccagatcttcgctcagggctaaaagcgccggggagtcaaagcgtgcattgatcagatcgtcaggttgaaagttatggatgttccacggaatgacctcaacgccggatgcttccagtttgcgctggcatagcgctaacaacgacgtggaccgtgaaggaaaccgcggactacctgccagggtaagcactctcatttacgactccttataactgaaagttattgattatcttttgttgagaactgaggctttcatcctggcagaggcaacggcagggcttaaatgatttttctgacaatctaaaggtaaaaattgcaaaaggatttcagataaaaacgtcaggactgagagataaaaccgatacgacaaatcttaaaaaaagcagggaaggtgcattgatacattaatccgggtgaataaacgccatgaaacccccggaatccgtacatttggttacttgaatatcaaaataatgaaacaaaggaatgaaacgaaaaacggtgttgttgttttttacgcgatacaaaaaaagaaagggtaaaaaatgtcgatgattcaacgtgatttcgtttggttcccggcgaagtattaggattagttgcatggaagggatggggattacgggcattttacatgaattttttaacggtaattcatgtttggttacagatagcgcagccaaaacgtcctgatgagataatgatttctaaatgatttctaaacaggggcgtgattatctgtcagttattctttagaaccgctaacgatgttttttttgatcgccttttcctgccgacattgagacaggcattttattgattcaggcagtaaaatgtctctgctcaatgtaagcgcctgttattttaaaaattactattcgcccttggtcagtgcctgtctcaggctggtggattttatttgtcattttctaacagcagagaaatctcgtatgtctgacatcctgttatcggtcattattcccacttacaatgttgaaaaatatattgtcgaatgcgttgattcattattacggcaaattagcgcgccaaacgaaattatcattgttaacgacagctctaccgatggaacggtagccttagttgaacagcactatggtcatcttccgcaggtgaaaatgatcacaatagccaacggcggtgcaggcaatgcgcgcgataaaggcgtagaagtggcgcaagggcagttcgttttcttttgcgatcctgatgatgtggtggcggacggattagtgagtgagcttactcaggtcgtcgaaaattatccggataccgatttattttgttttaattccagcgcgtaccgggaagataaaccgcacatcacctggcctaaagtcaggcacagcctgtctggcattcagcggccacaggatgtgctgttagcattgcttcataacggctcctatacctctgcagcctggaattacgtgctgagaaaaaccgttatccagcagcatcatttgcgctttgtcgatcgcgtgcatgaagatcataattttaccttatcggtatttatgaaatgcaaacaggcatgggtgacccagcagacgtattacaaacagcgcattcgtagtgggtcgctgaccaacagcagtaaaagtcctacctttttctttcagcgctacaatgcttttattgccactttcaacaccttgtgcagttcacgggcagaaagtgaattaaagaaggcgctggaaaaagcctaccttattcactcttttcgtttaatgatctatctgtcgctctacaaccaaacgccggtaccggaatatgtgctgaatgcgattcgttatctgggccgccgaattaaagccagcagccttaaagaatggctgctgttaaacagtccggaaaccttcattttattgcaaagccataaagtgaaaaaagaactcaaacgcgttccgtaattcctaaaagtggaccctgatgttgtttgcacctgaacgaaatgagaaggtgagacatgcaatgtgtataaggttgttgtgacatggcaaaagtgctcgacaaaagtttagtagtcaatatcttatctttactggcctaccggggagcctccttcctgtttccgttggcgaccttaccctatctggcgcgtgtgcttggggtggatcatatggggattctggcgctggcgattgcctgcgtcctttactgcagtaccatctctgactggggattcaatgtttttaccaccaaggacattgcccatcaccgggacgataaaacgcgtgtcacccagcttttctggtcgaccttcaacgccaaactgatgctgctgctggtgaccagcggcacgttactcacggcgacctggtttaatccgtcctggcattctctgttcttcattatcctggctaactgcaccaccttaatcggctctctgttttcattcggctggttaatgcaggggttcgaaaagctgggcaaaacggctgtcatcgcgacctttggtaacttttgcgccattcctctgacgtttttactggtgaaaacgccagaggatacctggctggctgccctgataccgggcgcggtgtcgattatcaacgccatcatcacgctgaaatttgtgctggaaatgaaggtgattggcgcgtatcgctttgagccacgcgaaatcaaacagcgcatcaccgacagtgccgatgtgtttattgctatcgcgggcgccaatctgtttaacagtgttaacgtcgtgattctggcttcttttacctcccattacatggtggggatctacaacggtgcggatcggttacgcaaggccgcgaactcggtgccagagcagattggtagtgcgtttttcccccgcgtcagtcacctgtttggccgcgacaaagcggcggcggtcgcagcaacacggaaaagcctgatgctgtcgtttgcgctgagcctggctatcgtgatctttacctggctgtttgccgatcaggttgtcgcgttgctgttaggtaaagacttcctgccctcagccgatgtgctgcgcgtctttgtactttgcttcctgtttggcaatatcgcgtatccggcgggcctgcagattttgatcccccatgggctggcacggcaacgcatgatggtgatgatggtcgcgggcgtgattaacgtcccggtttgctgcctgctggcgtggaaatttggtgccgtcggcgcggcctggtcgatggtgctggccgaagtattggtctgcatcggcattttcggcatcatggtgcggcacaaaatctggcgtgactatgcgttccccgacaggttgaattcacgtacagcaaacgattccgttgtgtaagatcaaaactgctttaaacagtcccctggcttaacgccccgcgatttacttttgcgccagagcaccttaccattctggcgcacaatttcctgtgcactgattttcaccatcgcttccgtcttccaggagagtgcatgttttactcaattgtccgaccggcattgttcaggctcgatcctgaacgtgcgcaccatctcacctttcagcaactgcgctttatgagcggtacaccgctggaaatgttcattcgccagaatttaccctcgcgtccggttagctgtatggggctgacgttcgacaatgcccttggccttgctgcgggcctggataagaatgccgagtgtatcgatgcatttggtgccatgggattcggctttgttgaagtgggaacggttacgccacgcgctcaggcgggcaacgacaagccgcgcatgtttcgcttagtcgaagcagaagggattattaaccgcatggggttcaataacctcggtgtcgataatctggtggaaaacgtaaaaaaatcccgttttaaaggtgtactggggatcaatattggcaaaaataaagatacgccggtagagcagggcaaagatgattacctgatctgcatggagaaggtgtatgcccatgcgggttatatcgctatcaatatttcgtctcctaatacgccaggtttacgctcgctgcaatatggtgaggcactggacgatctgctcttttccattaaagcgaaacaaaaagagctggaaaaacggcatctcaaatatgtgccggtggcggtaaagatcgcgccggatctttctgaggaagaattgatccaggtggctgacagtttaatacggcaccagattgatggcgttattgcgacaaataccacgctcgatcggtcgctggtaaatggtctgaaatatggcgaagaaatcggtggcttaagtggtcgtccggtacagtctcgcagcaccgccgtcattcagcggctgtcacaagaattacagggacgattgccaattattggcgtgggcggcattgattcgcttaccgcggcgcgtgaaaaaatagcggcaggcgccacgctggttcaaatttattctggttttatttataaagggccgggcttaattaaagatatcgtgagccatatctaagacattcgtcataataatgcgctggggggtttatttatccctccggctcgtttatattttgtcctgttgcacgatttttcagcattcatttttatttgatggattttttgcttttagcgtagcggtaaatacagggcacatgatgaaaattaaacccgatgacaaatggcgttggtattacgacgcagagcacgaccgaatgatgctcgatctggctgacggtatgctttttcgttcccgctatgcacgtaaaatgctgacgccggatgctttcaccgaatccggattttgtgttgatgatgctgcactctatttcacgtttgaagagaaatgtcgtcaaagcccgctcaacagcgatcaacgcgctgaactggtattaaatgcgctggttgctgcgcgttttctgaaacccctgatgccaaaaagctggcatttctcggcgcaccgtcagtcaatgcagccagctgtgggcgaaatggtcgaggtcacgctggctgaaaatggcgaacaggcgcgtctgttggtggtcgaaaatggcgacaacgccgcgctctgcttgctggcacagcccgcactgacgctggcgggcaagggaatggttcttggcgatgcgattaaagtgatgaacgatcggctgcaaccccacaagcaggaaaaagccacgcgctatgcgcgcgcggtgtaactcataccacgtcgatatcacccgccggaatacagctgcaactcaatatagtgccatcatcacggatggcgctctgctttaaggcttttacctttcccgcaaccagcgttattttacaactgccgcacaggccagcccgacacgaataaggaatgcggaagccctgcgcttcgagctgctcaagtaaaacctgctgattgtcgccgctgaagcgctggccctgccaggtgatcgtgacctgctggggcgcttgccgttgcggcttaagcgtttcgaccacctctcccggtccgtacgcgcgcggcggctggcgtttggttatcctgacctcgtctccggcacgaataataccgctgttgagcgcaatcagattcaggccaaaatcaatgtccccactgccatcctgcgccgttcgaaatccctggagcgtggccaaaggttggccatccggatgtttctggccgctttcaacgccaaccgtggtaaaaacacagcgactgcaaggcttaggaacggagaagtttacctgaccgatagctatttcagcccagttgtcttcatcccaggcgggtgcaccactcaccaccaggtttgggcgaaactgctcgatccgcacgctggctggacaacgctgctgtaaatcctgccacgacgcgttgttcactaacaggtagggatatccatcggcaaaactcagtggcacctctgtaaagcgcttcacacgacgtgagggctgcggcccgacccagcgcaactgtaccgcgcgtggaaaaaaaccactcagccactggttaatattgtctggcgcgatgcgcgaggtaaaggtgttgccccagacctccgtcggctgctcatcctgggtgaagtctacgaaacggataagcgactggctgccgtcgggggcttgtaaaaacaagccctctggcgtaatggccggcgtaaactgcaccatctctgggaactgacgcgcagtaataaaggtaccgtcaggttcggtcaccataaagatacggtcataggttaacccgctgttggcaacccaggcatgtgatacctgtaacccgcgcatggatttgacaggatggataaacaggcgggaaagcgtaatcatgaaggtctccaggagcaggcgcgcaagacaaaagaagctaactttatgacataggtctgcgattcgctataatgcgcaacaattttctcaagagtaaaaaagtgacgatatgaattctctgtttgccagcacggcgcgtgggctcgaagagctgttaaaaaatgagctggacgcgctgggcgcgcaggatttgcaagtggtacagggaggcgttcacttcaaagccgatgaccgcgttatgtaccaaagcctgatgtggagtcgtctggcttcgcgtattttgctgcccttgtctgaggttggcgtttacagcgatctcgatctctaccttggggtgcagggcatcgactggccagccatgttcggcagcgataaaacctttgtcgtgcattttaacggcaccaacgatgagattcgcaacagccagtttggcgcactgcgcgtgaaagatgcgattgtcgacagctttacccgccgtaatctggcacgcccggacgtcgatcgcgaacaagctgatatccgcatcaacgtgtggcttgacgacgatcgcgccagcatcgcgttggacttaagcggcagtgccttacatcagcgcggttatcgtcagcaaaccggacaggcgccgctgaaagagaacctggccgcagcgattgtgatgcgttcaggctggcagcccaccacgccgcttattgatccaatgtgtggttccgggaccttgctgattgaggccgcgctgatagcctgcgaccgcgcaccgggtttactgcgtaatcagtggggcttcaccgcctggtctggttttaacgaaagcctgtggcaagaggttaagagcgacgcacaggcgcgggcgcgtgtcggcaccgcagcatgtcaggcgcgtttttttggttatgacaataacggccgggtgctggagtgggcaaaatcgaacgcgcgccgcgccggtgtctttgaacacttcacctttgcacaacaggacctgctgaagctgcagaatcccgttaattcagaaacgctgggcacggtactcagtaacccaccttacggtgaacgtctggaaagcgagcctgcgcttattgccctgcacagtcagcttggtcggttgatgaagcagcattttgctggctggaatttgtcgctgtttagcgcgtctcccgagctgctgagttgcctgcaactgcgtgccgaccgtcagttcaaagccaaaaacggcccgctggactgtgtacagaaaaactatcagctgtcggcgaacagcgctgagcgcggtaatcagattgctgaagattacgcgaaccgtctgcgcaaaaacctcaagaagctggataagtgggcgcgccaggaaggcatcgagtgctaccgcatttatgacgccgatctgccggactataatgtggccgtggatcgctatgcggactgggtggtcgtgcaggaatatgcaccacccaaaaccatcgacgcgaacaaagcccgtcagcgtttgtttgatgtgattagcgctacgctgagcgtgcttgaattgccatcaaaccgcttaattcttaagacccgcgaacgtcaaaagggcaaagcgcagtatcaaaagctgagcgagaagggcgactattttgaagtgcaggagtttaacgcccgtttcctggtgaacctgaccgactatctggataccggattgttcctcgatcaccgcattgcccgcaagatgctgggccagatgagccagggcaaagattttctgaatctgtttgcgtacaccggttctgccagcgtacatgcgggtctgggcggcgcgcgctccaccaccaccgtggatatgtcgcgcacctatctggaatgggccgagcgtaacctgcggctcaacggcctgaccggccgtcaacatcgcctgcttcatgccgactgcctgagctggctgaacgagagcgatgagaatttcgacctgatctttatcgatccgcctacattttccaactcaaaacgtatggaagagagtttcgatgtgcagcgcgatcatatgatgctgatgcgtaacctgaaacgcctgttgcgtaaaggcggtaccatcatgttctcgaataacaaacgtggtttcaaaatggatctggatggccttaaggcattggggctccaggctcaggacatcactcagaaaaccctgtcacaggattttgcgcgtaaccgccaaattcataactgctggctgattactcatgctggtaaggaataagttacatgtcattaattagtatccacggcgcttatctgtcctttagcgatgcgccgctgttagacaataccgaactgcacatcgaagaaaatgagcgcgtgtgcctggtgggccgtaacggtgccggaaaatccacattgatgaaaatcattaatggcgagcagccgctggatgacggtcgcattatttatgaaaccgatctggtcgtggcacggcttcagcaggacccaccgcgtaatatcagcggttcggtgtatgattttgtggccgaaggcgtagaagagcaggcggagcatcttaaagcctaccatgcgatttcgcatcaggtgatggacgatccgagtgataaaaatctcaacgagatggcgcgcctgcaggggattctggatcatcacaatttgtggcagttggaaagccgtatcatggacgtgctgcagcagattggtctgtcgccggacaccgaactgtcctctttatccggcggctggttgcgtaaagccgcgctggggcgtgcgctggtcagtaatccccgcgtgctgatgctggatgagccaactaaccaccttgatattgaaacgatcgactggctggaaactttcctgaaaaccttcagcggcagcatcgtctttatctctcacgaccgatcttttatccgcaatatggccacccgtattgtggatctggaccgtggcaagctggtgtcatggccgggtaattacgacacctatctggaaggcaaagaagaagccttgcgcgttgaagagatgcaaaacgccgagtttgaccgcaagctggcgcaggaagaagtgtggattcgtcaaggcatcaaggcgcgtcgtacgcgtaatgaaggccgcgtgcgggcgttaaaagcgttgcgccgcgagcgctcagagcgccgtgaggtcatgggcaaagctaatatgcaggtcggtgaagcatcacgttccggtaaaattgtctttgaactggaaaatgtggattacgccgtggacggcaagcagctggtaaaagatttctctgcccaggtgcagcgcggcgacaagattgccctgattgggccgaacggttgtgggaaaaccaccttactgcgtctgatgctgcaacagctgaaggccgatcacggtcgtgtgcattcgggtaccaagcttgaggtcgcctatttcgatcagcaccgtgccgaactcgatcccgatcggacagtgatggacaacctggcggaaggcaagcaagaggtgttggtcaatggtaaaccacgccacgtgctgggctacctgcaggacttcctgttccatccaaaacgcgcgatgactcccgtcagggcgctgtcgggtggagaacgtaaccgcctgctgctggcgcgtctgttcctgcgccccagtaacctgatgattcttgatgaaccgaccaacgaccttgatgtggaaacgctggaactgctggaagagctcatcgatggctaccagggcaccgtgctgctggtcagccacgatcgtcagttcgttgacaacaccgtcaccgagtgctggatctttgaaggcaacggtgagatagggacctttgtcggcggctaccacgatgcgcagcagcagcgtgcggtttataaacagcaaaaggggcagggcgcagtaaaaggggcaaatagtgcccttaagccagccgatgctaaaaatgacgctgccaaacgtaacgcgaacaaactaagctataacctcacgcgtgaactggaacagttgccacaaaaactggaacagttagaggcgcgtattggcgagctgcaggccaggatgagtcatccggattttttcagtcagccacacgataaaacgcagccggtgttagatgaactggctgacgttgaacagcagttggaaaccgcttttgcgcgttgggaagagctggaatctatgagaaacggcgcatagcttaagggtccgggaatgtgttctgcagagaaaacgaacgcgtggatgctctgtccacagtgcgacttgatggtaaaactgccggacattcccgttggcagccgtgcgtcatgtccgcgctgccatacttcccttaccgtgaactggtcggagccgcgtaaacgtccgaccgggtatgcgctggccgcgctgtttatgttggtgctcgccaatctgtttccgtttatcaccatgaaagtcgccgggctgtccagccagattagcctgatgcaaatccccagggtgatggtggccgatgattacgccagcctggccacgttgttcctgctgtttgtccagggcattcccgccttttgcatgatcacgattgtcctgttggtcaatcaggtcaggatgcctgtcagcctgaaactggggctggcacgaagtcttttccatatgcgcaactggggcatggcagaaatctttatggctggcgtgctggtcagtttcgtgaagttaatggcttatggtgaaatcggtctcgaaaccagcttctggccgtggtgcctgttttgtctcttacagctacgggcgtttcagtgtctggatcgccgttggctgtggcagcacattgaacccatgccgcctttgcctcatgccccacaagcaggtgtcagtggattaaaacagggcctgcgctcctgcccgtgctgtactgcggtcttgccggtgacgaagcgggaatgtccgcgctgtggcgtggttgccgatgcgcgccgcaagcacagcctgcagtggacgctggccctgctgatcacctccgttatgctttacatccccgccaatttgctgccgataatgattaccgaaacgctggggtcggcgatgccatccaatattatggccggggtgattttactctggggtgatggttcctatccggtggcgttagttatttttatcgccagtattatggtcccgtccctgaaaatgctggcgattggctggctgtgttgggatgccagcgggcgcgggcagcgtgacagccataaaatgcacctgatctatgaggtggttgaatttgttggacgttggtcaatgattgacgtctttgtgattgcagtgctctccgcgctggtgcgtatggggcagttaatgaaagtttacccggcatggggagccgtattgtttgcgctggtggtgattctgaccatgattgcagcaatgacgtttgacccgcgcttaacctgggatcgtgctggtgaaaaaaacatgaaggagccgcatcttgacggaaaataatcacggtcatgccaaagtggatcagatcaagcgttggtctccggtatggatcgtccctattgttacgctgttaattggcggctggattcttttttatcactttagccatcagggaccggaagtcacgttgattaccgagagcgccgagggcattgaagcgggtaaaaccaccataaaaagccgcagcgttaacgtgggtgtggttgaaagtgcggtactgactgacgatcttcaccacgttgagattaaagcccgactgaatgccggtatggaaaagctgctacacagcgacagcgcattttgggtggtcaaaccccaggtgggtcgtgaaggcattaccggtttaggcacgctgctgtccggggcatatattgagctccagccgggtaccaaaaaagaacccctggatcagtacactttgctggatgcgccacctttagcgccgcctgatgcgaagggcatccgcattatcctcgacagtaaaaaagcgggacagcttaacgcgggtgatccggtgctgttccggggctatcgtgttggcaccgttgaaaccagcagttttgataccgataaacgcatgatgacctatcagctgtttatcgccgccccttacgaccgcctggtgaccaccaatgtgcgcttctggaaagacagcggcattgccgttgatatgtcggcgtcaggcatgcgggttgaaatgggatcgctgaccacgctgttcagcggcggggtcagctttgatgtgccagatggctgggatttaggcaaagcggcgcaaaatcatgcggattatcatctgtttgacgatcaacgcagtattcaggactctctgtataccacgcatatcgactacttattgttcttctcggattccattcgcgggctgcaggtcggtgcgccggtggaattccgcggcattcgtctgggtacggtttcagaagtgccgtttatgaatgcaggcactgcgcaggcgctgaataacgactaccgcgtgccggtgttgattcgcattgaacctgatcgtttcattagtcgtttgggtgaaaacttcgacattgaacagcatctccaggatggtaagaaacacggcctgcgcgctacgttgaaaaccggcaacctgttatctggtgcgctgtttgtcgatatcgacttctatgacaatgcaccggtgtataaaggcccggataaagtggcgggttatgaagtgatcccgacggtgagcggcggcttgagccagattcagcagaaactgatggctgcgctggataaaattaacggtttaccgctaaacaatatggtgtcggaagcaaccggaacgctgaaggagagccagaaaaccctgcgcgatctgcaacgtaccattgataacatcaacgtcgttaccagtagtccggcgatgaaaacgctgcctgaagagacccagcagacgctacgtgagcttaaccgcagtatgaaaggattgcagccaggttcacctgcctacagcaagctggtgggcgatatgcaacggcttgatcaggtgctgcgtgaactgcagccagtgctgaagacgctaaatgccaaaagtaatgcgttagtgtttgaagcaaaaccgggacaggatccccagccgaagagggcgaaacaatgaaaaaaggactcgtttttttggccgctctcgcactgagtgcctgtagcagcacggtgaataccacttactatcagctgccctcaggggcagcctcgatgcaggtgatcagcagtgaggcaaacgcacagccgacattgtgggtgcagcaggtggtcgtaccggattacctggcgggtaacggcctggtttatcaaaccagtgacgtgaaatacgttatagccgccaataatttgtgggccagtccgcttgatcagcagcttcagcaaacgttaattaccaatctcaccaaagccttgccgggtcgtctggtcactcagacgttaatcgggcaagaacacgatacgctgaacgtgacggtaaacgacttccagggcaggtatgacggcaaggtggtgattagcgggcagtggacgctggaacatcagggacgcttcacaaagcaagcgttcagtctggtactgccacagcgagaagatggctatgatgcgttagtcaaaacgcttgcccagggctggcagcagatagctcaacagattgcgcgtaacgctgtcactgcccattcagcggggatgggcttttagttaacttattgtttcgaatcgtataagttttttgacgttatcgaaggtttctatataaatcatacggataaagcaataggcttacatcacgaaacagaaaatttatgtccggttcaggtcacatttgtgacattggcgtgaagattgcgcattgatcttttcatacagagcgagtaaaacaaaagggtggctgaacatttattagccatctttttctttccaccagattccacataccttacatgagggacacggagtatgaagagacagaaacgagaccgccttgagcgcgcccattcacgtggttatcaagctggcattacaggacgctctaaagagatgtgtccgtatcaaatgatagacgctaagtctcactggttgggaggttggcgacaagccatggaggacaggtcggctgctgcgtagccggatgtcactgaaaagggatataacctccgcatcaagcggaggttttcatttctgcggggaacgtatcagaatgctgcggtatctttgaacagacctactttcaaatcgctggcagtataaatgagattaccatcaaccagcacttcaccatcggcaacgcccatcaccagcttacggttaatgacacgtttgaagtgaatgcgatacgtcacttttttagcttctggcagaacctggccggtgaattttacttcgcctacacccagcgcacgacctttgccttcgccacccagccagccgagataaaagcccaccagctgccacattgcatcaagacccaggcaaccaggcataaccggatcgccaataaagtggcaaccaaagaaccacaggtccggattgatatccagctcagcttccacgaagcctttatcgtacttaccaccgtcttccgtcattttgaccacgcggtccatcatcagcatattgccggatggaagcggcggaccattttcgccgaacagttcaccgcgaccagacaggatcaggtcttctttggtataggattcgcgtttatctaccatgttctcaataagccttcttttagtgaatctcgaatattagcgaacagttgtatgctgagcaaatgggattagcggtggttaaaccagttaagccaccgcagcggccagaatcgtggtgaaggctctggttgattcatctgactgatgcgttcctgaatcgtacgcagcagacattcgccttcgccatcttccgtattccatattttacctgtcagcagaggcagcgcttcatcagcacgatcgattgcccagatatgaaaacgtccctcttcgaccgcgctgaccacctgctggttcagactgaggtgacgaacgttacaggcaggaatgatgacgccctgctgtccggtcaattcacgctgatggcagatatcgaaaaacccttcgatcttttcattcagtccgccaaccggttgcacattaccaaactgatcgaccgagccggtgaccgcaacctgctgattcaagggttcgctggcgagggcgctaatcaaggcgcacagttctgccagcgacgcgctgtcgccatccacttcggaataagattgttcaaacaccagcgacgctgaaaacggcagttgctgatccagctccagttcagcaatcaggtaggcctgcataatcatcatgcctttagcatgaatattgccacctagctccgctttgcgttcgacatcggtaaattcaccgtcaccgggatgcaccacgcaggtaatacggcagggatcgccccaggctcgcggatgaccgggatattccaccactgacaggccgtttatctgaccaacgacttcaccttctgtttcgaccaaaatttggcgctgcagaatctcatcacgcaaacgttcgttgaggtagttctcacgccacagccgtgcttccagcgcgtcacgcagtgcttcggcgctgagcgtgtcacccatcagggtggtttcacgcagctggcgcagcagccagcgtgggcagagcggaagggtttcctgatcgccgctataacggacgccttccttgatcagttctggccagaagtcttcatcggggacggcgatatccgcctggctggcaagatcgactgtccagcgacaccatgcgagcatgtcgtcttcatccaggatctgaatattttcttcaaattcagtgtaaatcgccatttcgtgagcttcagcatccagctcctgaaaatcagccagcgtgtcacgttcaccacagagcaccagattcagctgaagcggaagcgggggaacggaaaccggcaggggacgacgttcgtcctgtgacaaccactcaatgtagccttgttcaatagactttttcagccgtagccacagcagcggctgagtgagcaatgcgcgcagtgaaagtaccagtgttccgccgttggcacgatgaataaggcccggctcaagctgaatacgatctttgtgcatccgaacacagccaaacagcgcttcctgctcgatccagtcagcatagtgaatgccaccctgactggtaaacgggcgctggctgtcggttggcggctgcaaggtaacgttgtcggccatgatgtggtagtcaccacctgacagtgctgacgaatggcccataacgcgttgtgctgcatcagctatcaacgcaagatagtcacggttttcctggctgcgaaccagcaacagtgggaaaccctgactttgatgatgtaaatgggccagcgcgttcagcagtcggggctgtaccgttgctaaggcatcggtctcttcgtcagcaattcgggagaaaacggattgatattgcgtactatccggctgtaaggtttgccacgtaagttgagtgctggtcaaaataatcgcatttgtctgttttgagaaaagcgagattatacaggattcaccttgcttaagcactgcagagttcaatcagatgttgtgacgctggcagcatgtttttcgttgctgcatccggtaaaaaagctgttattcttagttcgttacgtgatcacgatgagattccgatgaaataccagcagctcgaaaatcttgaaagtggatggaagtggaaatacctggtgaaaaaacatcgggaaggtgagctgatcacgcgtcacctggaactcagtgctgcgcaggccgcggtcgataagctgttggtgatggaaaataatccggtagaaattaacgactggatcaaccagcatattcatcccgatctggacaaccgacttaagcaaactatccgtgcccggcgaaagcgccatttcaatgctgagcatcagcacacacgtaaaaaatcaatcgatctggaatacctggtctggcaacggctggcgggattagcgcagcgccgtaacagtacgctgtccgaaaccatcgtacagctcatcgaagatgccgaacgcaaagagaagtacgccagccaaatgtcgacgctgaagcaggatctgcaggcgatattaggcaactcgggttctgaaaaagagtagtgggcgtaccatctggacagccgcttcagagcagaaacccccatgagccataccatattcaggaaaaaaaaaaccccgcattagcggggttttttatcacgtataacttaagcctgtggctgagttacaacgtctttgatgcctttaacatcgatttctacacgacggtctggcgccaggcagtcgatcagggccttacgacctttcacgctgtcacaggtgttgccagtaactgggttagattcacccatgccgcgagcagagatcttgttagtagggatacctttagataccaggtaatctactactgactgagcacgtttctcagacagtttctggttgtactgctctgaaccgatgcgatcggtaaagcccagaacaactactgaaccgtctttaggatccattgagctcagctggctgtacagctgatccagagcctgctgaccttctggcttcagagtcgacttgttgaacgtgaacaggacgtctgatttcagagtgaagcgcttggtctgaaccactggcgctggagctggtgctggagccggagctggtgcagcaacatcatcctgaccgaagcggtaagaaacacccaggctcagcatgccgttgtctggacgagcaccaacggtctgtgcatcaccgatgttgttaacccactggtaatccagacgggttgcccagtttttggtcagcgcatattcaacaccaacagctgccagtggagaaacaccggtgtcgtggtcgctgatgcgagtgccagtagctacgttctgctgagtagagtctgcacgccataccatgccacccaggcgggtatagatgtccagatcgtctgcgattgggtagctcagtttggcagccagctggatgccctgtgctttaaatgcgccattcacctggttgcctttattaggcatacgacctaaccagtcataacccagttcaaaacccaggtatgggttagcctggtaaccaccgaacgcacccgcgcccagttggctttcatgagttgggccgtcgttgttttggtaaccgtgaccgtagtaaccagtgtcgtgatactgagaccagcccagtttagcaccggtgtaccaggtgttatcttttggggcggcctgcgctacggtagcgaagccagccagtgccactgcaattgcgatagctgtctttttcattttgcgcctcgttatcatccaaataggcaatgagcataaaggttgctcttggtttaatccttcgccgggtcaaaacgctcgcttatgactctaccgcaaaaaacggaggttattgagcaccctggcgagataaagtctacaacgagattggaaacttacaagtgtgatgtgaggcacttatgtaaaaaaacagtgttttatacataatttctaacaatttagcctgaacttctgtggggtgcttaccccacaaaaagggggctaagccgttgtcattactggggggagcagaatcagtgtcttagcctttagtcagataaaaaagctgttgagataaatctcattttttacttaatgaaacaaatcagactgaatttttagcgaactttctggtcttactgccgttttgggagtttcacccgaccgcaaaatgagccccagggctttcccttccgccgccgcaagttccagttcacgacgttcatcttcatccagttcgtagggaatccaggccaaaacaacactgtaatttcctgtgcgtaacgctttaatcatggcctctacagcattgtaacgttcagcatcggcgatatgcatacttttctcaagtggcaaacccgattcctgcatccaggcccggctcaacttatgggcaggcgttaaccacagttgccagcgagattgttgactcaattgctgtagcagcggtaacaacagcatctgcatcatgccaggctgttcgctgtaacgtaattcagtgatccagcctccgtgcgttgccggaacagaggacaaggcgtaacggtgagcagagcatacattactggtatgttgggtgcgcataaattattcactcagcagttgactgtatggatatacagtaatgacatcctggataaagatcaacctgaatttctgaaaatgcctcgcaaaatttgcacaaggttgtgtttaaacggatttattcattgaacctgttactgaatttacttatcttctaaccgtctgaatagtaacgtttttaacaggtttttgttacaaggaggtgatgatatgaagaaacagcagcgggtcatcctgcgctcaatacagcagttggccccgttgggtcatgttcaatcccgtacccagtttggtggctatgccctggcggttgaacgggtcgtttttgcactgataaaagaagatcagctctatttacgcgccagtgaagaattacgggaatatgtggcagaacagccgctggaaccgcttacgtttcgcaaacgcgggatagcggtcagcctgaattattataaggtcgatgacaacctgtgggctcacccagagcatctggtcgcgctgtctgccgcttcactggaaaccgcccggcgtgaacaagatgaccgccagggcaaggtgcgtttaaaagacctgccgaatgtcagtctgcgactggaaatgatgctgcatgagataggtatctgtaccgtaaaacacttgcatgaagcaggggccaaacagtgttggttaaaactgagacgcaacaaccatcatcttggcctcaaaacgctgttagcgcttgaaggggcgatttccggtcatcatcaggcggcgctgccgcaaaccattaaaaccgagttaggcgagtggtatcaggccgcactgatgatgtcggaggggaaagaaaaaggccgttagcgtttgcccagtgtgcgtcgcaggcgtgcaatgtcgggcatcagcgcgaccagtaaacccagttgctgtagcaccagcggcgcacgtgggtccggctcggtagtgagctgcgcgatgcgctgcaccagttcaatacgcattttttctgcccggctgtcactgaccacatccgtctgcagcacatcctcgacataacataccgtatcgtcgagcagcgccagcagggcaggctgcgtcactttgtctcggtgcgcgcccagcgcagagatatagctcaggaaggagtgattcaggcacagtaactgaaacgccgactcccgaagtttaaggctggtgcgggtctcactgctcatattggatactaccgatgccagctcggcatcagcgttgtgcgcgtcacgacgggcaatacgataagcaagacgattgtctttaccctgatgatattgctccataatggcatcaagatagcgacagttagcattcaacgttcgtgtggcgacggccggaagttggcgaaagcgccagtcaggccagataaaggtgaccgccagccaggccagcgcgcagcccagcagcgtatcaacgacccggggtaatgccacttcaaaaccttcacccagcaggttaaaacaaagcagaaccagcagggtaataaacagggttgcctgggcgtattgcacctggcgaaacgcaaagaacaggacaccggtcacgacaatcaaaaacagctggccttccacagagggcaccagccacagtaaaggcaagccaatagcaatgcctgccagcgttcccccgatgcgcagtgccagtctgcgctgggtcgcactgtagttgggctggcaaacaaacaggctggtcaacaggatccagtagccgcgctccagaccggtgatctgaataaatccatatccgacgcacatcaccactgacatcctgacagcatgacgaaacagcgcagaggcgggcgtcagatggcggctcaggcgcagcttaatgtcgctccagccactgagctcctcgcgcgacagcatattgtcgctgtgctgcggatcgtccgccagtgcctgctcagactcaatagaggccagttgcgcatcaatcgcttgcaggttacgtaataaccaaaacagcgcgccggtatgggctgcatccggatggctctgttcaagacgttgaatagcgttgtgtaaacgctcaaaaacgcgctcaaaacgactgtcatgttcccaacgttcgcgcagtaaaagcgcgcgggccagttgccggcatgcctgagcctgcatgttaagcaggcgctgaaagcgaaacagaatttcgttataacgccagttgccgcgcagtaaatggtactgaagatgagacgagctggcgcgttcgtggatgtcctgggcgacaaaatagtagtgcaggctccgccgggtgccacgcgaacccctgtcgccacgtaaacggctctgcagggttgttttggtcagattgagctgggcgacaagctggctgttcaccatggccgcctcaacaaaagtcgcatcgtcctggtcatcggcatcaggatcaaacaggttggctttggcatccagatagtgcgctaactgagaaaaactggctgccagttgttcctgaaccgggcgaacgggaaacatcatgtggcccaacagcgtcagcaggttataccagagcgcgccgaccagcagcagcatgggctgcagataccactgtgaaaaaagtccgatgcccagcatggtgtaaacggcaatcaacaatgcgccgaaagcaatggtggcatagcgctgccccagcgcgcccagcagaatgaaaccccaggtggagatggccaggccgacaataaaggccagcgggtgagggaataacagctctactgaaaccgaagcaatacaaaagcacaacagggtgattaacaggttttttaaacgcccagccagccgatcatccagatcggccagcgcggcggcgaccacgccaagggtcaagggaatggtccagtcaatctgctgcagtaaccagggaaccgctgcgcatccgctcaaggcgaacaggatacgcagcaggtaacgccaggtgctgttaaaaaaatacttgcgccatcccgacagaatattaatagcggcgacgggcattggcatcacgcgcggcacgcgcctcttcgacagagacaacccgacgacctaccggccagagtgcaatggcggcaatcttgaagtttgcgatacctactggaatgccaatgatgctgatgcactgcacaataccgactgaaatgtgggacaggcacagccaccagccgaaaaaaatcagccagaagatattcaggaaggttccccccgtattcatgatgtgacttttactgtcgggacgcaggacgtccacatgcaccgcttcattgccaaacggcagaaacgagagcctggtgatttcccagcaggagcgcgtcaacggcagggtaaaaaccagtacaacgctgataagcgttgcgaacaaccaactgagcgtggtgaagaatccacctaaaacaaaattgagaatatttaaaacagtgcgcataacccgcttttccttttgcactccgcaagatatgtcgcagtttaccgtgttttaaggctggagcgtcaagagtctgacaggtaaactccgattactctttatatcggtcgttggtgtcggcgtggaacttaaagcaacatccatgggcaaacggcttgcccagcatccttacaatcgggttcgcctgttggccgctggcgttgaagtcagcggcgataaacacgaatatctgctcccctttaatcaactgtccgacattacctgtaagcgtggcatggtctggggagagctggagtttttgctggcggacggtaaagttgtgcgtttgcatggcaccgaatggcaggagacccaacgtttctaccactaccttatgcagtcatggcaggcatggagccatgaaatgagtgaggtatgcgcggcagtattacaggatcttcgtgaggaaattcaaggtttcagcgagcaggaccgttggttaaagcgcagtgaactgcaggccgttaagaaccagatacttaagcagttcgatgccttacccttgccgctatcccgcatcgagagttttgattcctgccgtgaaaactgggcattttgccaacactggttacagcagggtgacgcggcaatcggccagcgcaaccgcgactggacggccgcgatgttaacccgctatcaggatttcttcgccacggttgagtccacaccacttaatacctcacaagccgaagccgtggtcaatggtgaagatgcggtgctggtgcttgccggtgcgggcagcggtaaaacgtccgtgctggttgcccgcgcgggctggttattagcgcgcaggctcgcctccgccgatcaaattctgctattggcgtttggccgtcacgcggctgaagaaatgaatgaccgcattcaacgtcggctagatgtggccgatatgcaggcgcgtacttttcattccctggccttgcatatcattcgcgaaggcagcaataaacagcctgttatcagtaaactggaaagcgacgccggcgcacgccgggcgttgctggtcgagcactggcggcaacagtgtaacgaaaagaaggctcaggccaatggctggcggcaatggctgcgtgatgaactggcgtgggagatcagcgaaggtgcattctggcaagatgatcggttagctgagcgcctggctccccgccttgaacgctggctgagtctgatgcgcatgcacggtggcgcgcaggccgccatgattgcggacgtccctgacgcgctacgcgacctgttcagtaaacggatcaaactgatggcaccgctgctcaaagcctggaagagtgcacttaaagatgagggcgccgtcgatttttcagggctgattcaccaggctgtcgcgattctggaaaagggccgttttatcagcccgtggaagcatattctggtggatgagttccaggacatttccccgcaacgcgcggccttactgagcgcactgcgccagcaaaacaagcgtaccacgctgtttgctgtgggggatgactggcaggcgatttatcgcttcagtggggctgaaatgagcctgacaacggcgtttcatcactatttcggtgagggcgaccgctgcgtgctggacaccacttaccgcttcaacgatcgtattggcgagattgccaaccgctttattcagcaaaatccgcatcagttgcgtaagcccttaaacagcctgattaaaggcaataaaaagtctatcgcgctgttgccccaggatcagctggaggcgctgctgaataaactgagtggttatgcaaaacccgatgagcgagtgctgctactggcacgctatcactatttgcgcccggatttactggataaagccaaaacccgctggccaaaattaaacatcgactttctgactattcatgccagcaaaggccagcaggccgattacgtgattctgctggggcttcaacaaggcaaagagggctttcccgcggttcagcgcgagtcaattattgagcaaggcttgctgcctcagcctgaagcctttcccgatgcagaagagcgccgactggcttacgtcgcgctcacgcgcgcgcgacagcaggtctggttgctcttcgataagcagcaaccgtcggtctttgtcgaggcatttcgtgaactggacgtgccggtgctgcgcaaagcctgagttatttcagacgttcagccaggtagcgttcatagtctggaatgcgtatatcgacggactgagcaaacagcggcgactgaataataaaatcggcagttgcccgattggttgcaaccggaatattccaaaccgtggccagacgcagcagggctttgacgtcaggatcgtgaggaaccgcatttaacggatcccaaaaaaacatcagtgcgtcaattttaccctcggcaatcaatgcgccaacctgctgatctccgcccattgggccactcagcatcgcattgacgttcaggccggtgtgacggtttatcagattacccgtggtgcctgtcgcatagagaatatggggttcgagcgctggctgattacgtgtgacccagtccagcagagaggctttgcagtggtcatgggcgaccagcgcgatatgtttttgttttccaagggtacgtagggtgtattccataacagcatcctgatgcaaaggagcaaatcgcccgttgcagcagtttacctcgtgctatttcagactatcaacttgcacgcaacattttgaccagatttataaactgctgacgcgtggcctcatcgaaacgctgaaaccagtgctgaagtgacggagttgtggtgtcaacagaccaggcaaggtcggcggtgagttgtgccgacggggatggcgaggtgagattggcgaattgcggtacagaagccgctaatcccatacgattgtaatcgaccatcgctttttcaacatccgcaccggctgtaacaggcagacggtcacgcacgctaaaaacctctttgcctttttcatccaccagcctgaaggccagtgaacggtcaaaattatgacgttcccgtggattgttgagctgcggcaggcggatggcaatggtttttgcttgagctgagaaggtcacaatcatcgggacagactgatagcgttgagcaacggttttattgtcacccggctgttgttccacccgaaataaaaactgatgttgaccacgctccagttctaaactgtcagcccctttcagcagtgaaccagaaatcttccgaccatctaaaaccatcaaggtgatctggggatcaagtttcagggtaattgcagagcaggatgccgaaacgaggagcgcaatgaaccccgttacagccattgacagcttcatttcgactccggttgacagtggatggatgtagcaaattcttacattatggcattaagtttacaattatacatatttattctaacgaagcggcacaatatgtctttgcaactcacgtcatgagtatcaaggctcatctacaatgaagagcagactcaaaggagaagcgcatgaatgatcagactattcgcgacgtattgacccggacaaagcgtattgccttagtcggtgccagcgatcgcccggaacgtcccagttatggcgtaatgaagtatttgctcgaccagggttatgaggtgattccggtaagtcctaagctggcaggccaaacgctgttaggacaaaccgcctatggttcactggcggaagtccctggaaaaattgatatggtggatgtgttccgcaattcagaagcggcctggggcgtggcgcaggatgccattgcagtgggagcagatacgctctggttacagctgggtgtgatcaatgagcaggctgcggtgctggcccaggatgcggggatgacggttattatggatcgctgccccaaaattgagatcccacggctgggtttggggcattaaatgcagcggcggcaaacagattgccgcctgctgttagtgacgcaaatgcggcgcctgaagctgctgacgcacagatgcagccagttcatccatcgacggctgctcgggatgttccgggctggtttctccagcaagctgaatttcggcgacgtaggtatgtacctgactgccttgctcatcttccatcacgacatggtaccagggcgcgctacgcatggtatcgactgctccgatctcatccagctgtggctcatctaacgcgtattcaggatcgacatcgacaatcacacccagcacgccggataaccgatgacgaacctgctgaccaataccaaatttactggcaatcatgatgacctccgaaaaatactgtcctgcatcatagatgggggcgaggacagtcttttcaagtcacatgacgcggcaggcgaaacctttcaggtaaaggccttccggataggtggcaatcactgggtgatccgcagcctgacggaattgctcaacaaactgtacgtcacggcctgcatccagtgcggcatcggcgatgattttctggaacagatcagtagccattaagcccgagcaggaaaacgtgagtaacattccgccgggattcagcaactgaatcgccagcatgttgatgtctttatagccacggcaggcgcccataagctgacttttattttcaacaaactttggcgggtccatgatgatgagatcgaatttctcaccattatcacgatagcggcgcagcagtttaaagacgtcatcgcgctggaactgagcacgggaaacatctaatccgttcagctcaacgttttgacgtgccacatccagcgcatcctgtgatgtatcaacgctaatcacttctctacaaccgcccattaacgccgagacggcaaaacccccggtatacgaaaagcagttcagcacgcgagcgtcttttgcatagcgtcgtgttgcatagcggctgtcgcgctgatccaggtaatagcccgttttatggccgccctggatatccaccagcagcttcatatcgtgttccgtaatcggcaacagcgcgggaggttgttcaccggttacggttccctgcgtcagctccagcccttcttttttacgaaccgcgacgtcggagcgatcgtagatagcgcaatccggaaaacactgctgcaacgctgaaataatggcagggcgctgatactcggccccggcagacagcaactgaagcaccaaaaagtggccaaagcgatcgatggttacgccaggcaggccgtcggactcgccggcaatcaggcgatagctgtccagtccgtcgcgtgccgccagccagtcgcgccagatttgtgcttgctgaaaacggcggacaaagaaagcgatatcgatagattcgtcctgctgccagctccagacgcgagcgcgaatttgtgactgaggtgaataagcggcacgcgccagccatttaccattactgtcacaaacatcaatggtttccccctgctgggctttaccttcaagacgggcgaccgccccagagaaaacccagggatgacgacggagcagggacttttcacgtcccttggcgagaatcaatcgaactgtcatagtttgctatgcttacctgaaaaaatgaggcgctattgtccagtggataacggcaaattgcaacgaacagcaggagagaaccatggcgatggtgtgttacaaagcctgggtacagggcaccgtgcagggcgtgggtttccgctacagcacgcaggcgaaagccaatgcgctcggcgtaaaaggttatgcgcgtaatctcgatgatggccgcgttgaagtgctggccagtggtgaagcagagcaggtggaggctttagtggcctggttaaaggccggagggccgcgcacggcacaggtggagaacgtgtgggtggagccgcatcagcccgccgacatcccacagcgttttaccaccggctgattaaagacattttgcgggcttgggcaggccggcaatttttgtcgcctgtttagcgggcccctccgggaacaggcgaaacagatagcggctgttccctttttcttcgccatactttttcgccatggcttttaccagcatacgtacggcgggcgaggtattaaattccagataaaagtcacgcacaaagtgcaccacttcccagtgggcatcagtcatcacgatagcttcgctttccgcaatctgccgggccagcccttcactccagtcatggtggtttttcaaatagccttcggcatcgacagcgatttcatcaccgttgtagttcatcgtgcttcctcatcgttatttgggctgcagtttaccaaactgacagcgcagaaaaagcaaaaaccccgccggggcggggttttcgtcgcttcaactacggcgattaattgctgcgggaaaaacctaatatgcttaacagactaacaaagatgttatacagggaaacatacaggcttaccgtggcacgaatatagttggtttcgccaccatgaataatgttgctggtttcccacaaaatcgcaccggcagagaacaggataaacagcgcgctgatcgccaggtgcagcgccggaagttgcaggaacaggttagccacaacggcaaccagtaacaccacgaagcccgccatcatcatgccgcccaggaaggacatgtcacgacctgttgtcagcacgtaggctgaacagcagaagaacaccagcgccgttccccctaacgccagcgcgatcacgtcacccattcccgcggtcaggaaggaacttaagatgggccccaggcagtaacccaggaagcctgtaaaggcaaacgcggctaaaatgcccatagggctgtcagccaggcgataggtcaggaacatcaggccatagaagcccaccagcatcagaatcaagccgggagccggtaatgccagtagcgtactggcggtagccgttagtgcagagaaggcaagcgtaaggcccagcagaaaataggtgttacgcagcactttatgtgtgctgagtaatgactgtcgcgatgatgaagaaactattctgtccatgttgcgctcctgtaaggcagaacaccaaatatgtgctgagaatacgcagcactatagagagggaaaagccgttttacccttctttacgcgttaacgcgttaattctttgagcagaatggcgatttcgccaacgaataacgcgaatttggctgtttttcaggcgaacggattatcacaggctttacatctccataggggatgtttatagtgcgcgtcattgcggaggggtggccgagcggcttaaggcagcggtcttgaaaaccgccgatgggaaaccatccgagagttcgaatctctcctcctccgccacttcattgaccagtcaggcatgaagcggcaagacagagtaatagcatcttgcctttgcagtagtgttacaatccggagggatggccgagcggcttaaggcagcggtcttgaaaaccgccgatgggaaaccatccgagagttcgaatctctcttcctccgccacattttacaggccagcacagcgtgctggcctgtttcgtttcattccttcctccccacctgtcattaattatctcttcgttttcagcaaactgtacggttttgaacggcgtccagcatctctgctatagtccattaattgtttttactgttgcctggcgcttttcgggggcaagctgagttacactattcgccacgtcgctctgatgcgtgctaatcggttgatagccagagtgtttttttactgaatgaatggaataggcacaatgatcaagaaactgagtctttgcgcattgtcggtacttgctgcattaccgattgggacgctggcacacgccgctgacaacgatatgcagttacaacaggtgctgatgttcagccgccataacctgcgtgcaccgcttgcggataacggcagcgtgctggcacagtccacgaaaaaaaattggccggaatgggatgttccgggtggacaactgaccacgaaaggcggtgtgctggaagtgtatatgggtaattatacgcgtcagtggcttgcgcagcagggactggttaagaacggcgtctgcccggacagcaacagcgtctttgtttatgcaaacagtctgcagcgcaccgtggcgacggcgcagttctttgtgaatggtgctttcccaggttgtgatattgctgttacccatcaggatgaaatgggtagcatggacccggtatttaatccggttatcactgagggtaatgaagaattcatcaaaaaagcgctggcgggcatgaccgcagccaatgaaaaactgtcactgaaacccgctttccagcgtcttgaaaagattgttgattacaaatcgtctcccgcctgtaacaacaaaaagcagtgcgatttgagtacgggtcagaacacatttatcgcggaaaacggcaaagaacctggcgtgaacgggccacttaaagtgggcaattcactcatggatgcctttacgctgcaatattacgaaggcttcccactggatcaggttgcctggggacaaatcaaaacgcctgaacagtggcaggcgctttcagccattaaaaatggctatcaggatgtgctgttcaccacgccagatgtggcacgcgatgtcgctgcgccgctggtggactacattcgcagccagcttatcgatcaggaaaagtcagactcgccaaaagtcacgctgatggttgggcatgattccaacattgcgtcactgctgagtgcgttacaggttaagccttatgaattacctgatacctacgaaaaaacgccgatcggcgggcaggtggtgtttgagcgttggcacgatgcgaaaaacaacaaagatttgctgaaaatcgaatacgtttatcaaacagccgatcaactgcgcgatgcagaagtactgagcctgaagaagccacctaagcgcgtgacgctgcaactggcaggttgccagacagacgctaacggttactgcagttgggatcagtttgcccaggtattaaacagctcgcttcagggcacagcactgcagcctgcggcgccggaacagcccgctgcagcggcgaaacctgacgatgcaaaagcggcaaccgatagtgccgcagcgcaaaaggcggaggctgacaaggccgctgccgataaagcggctgatgaaaaggccaaagcggataaagccgctgctgacaaagccactgctcaaaaagcagccgatgataaggctaatgctgacaaggcggcggcagagaaggccgctgctcagaaggcggctgacgaaaaagccaaggcagataaggcggcagcgcagaaagcggctgatgataaggctaaggctgacagtgctgcaccacaggcgggaagcaataatgccaccgccaatactgcgccagccaaaactgaaaatggtgatgcgaagcaacctgcggcagcgaactaatcctgttcagcacctgaaaataaaaaaccccgtcaagacggggtttttttatggcaacgctatgcttagcttgcaaccacaaccagcttttggttagcaaactctttaatgccaaggtcggaaagttcgcgtccataaccggaacgttttactccgccgaacggaagctcagcggacgtgtcgctttgcgaattaataaacaccatgcctgtttcaatggcggaggccagcttacgaccgcgggcaatatcctgggtccacaccgaaccgcctaagccgtaatgcgaatcgttggccagcgccaccgcttcagcatcgttagccaccacgtacatttgcgcgacggggccaaaaaactcctcgaagtacgccgggttatcgcgcgtaatgttggtcaatacagtcggctggtagaaacaacctacacccgccacggctttgccgccggtaatcagccgcgcgccattcgccaccgcttcatcaacctgttttaccagacgatcgcgcgcatccgcggaggaaagggggccgagggtcgttttctcatccagtggatcgcccagggttgctgcattcagcgccgcgctgaacttatcaataaaggtgtccgcaattttctcattgaggataaagcgtttggcggcagtacaaacctgaccacagttgctcagtcgcgcctgtacgccctgacgcaccgcctcatcaagatcggcatcttcggtcacaacgaaaacatcattgccacccagctcaagcgtcgattttttcagatgtttgcctgcctgctctgcaacagcactcccggcacgttcggaacccgtaagcgccacgccctgaacacggtcatcggcaatgagttctgccacctgatcggttgagataaacagattagtccaggccccttcgggcgcacctgcttccccgaccagtttttcaaacacgtcagcacaatgcggaacaatgttggcatgcttagccaggacagggtttcccagcgccaggttaggtgccagtacgcgcattaactgataatacgggaagttccagggttcaacggccaccagaacaccgatagggtgatattcaacccaggcttccccgagttcactgttataaggctgtggcttaagaatgcgttcagcattctcggcatagtaacgggcaatctgagaacaaatttgtacttcaccgcggctctggccaatcagtttgcccatttctttactggcgatgcttgccagttcttccgctcggtcatcaatcaggtcagccagttttttcagcacctggaggcgtggctgaatatcgcctttgctccagtctgagtggtacaggtgatcggccgtttccagcgcatggctaactgccgcgctgtcgtgggaaggccagcttttcattaactggttgttagcagggttgatgctttgataggaagacatgcagctctccttggtcagcgagtaaaaaaagcatggcgggataacccgccacactgtcagacgtttttgcgttctacgggtttgtcgtcccaggtaaggacatccgcatcggttttttcaaatgcgcggattaaaacatcgtcactgccttgttgacgccagatttcttcagcaaggcgctcgtcatagtttgcgacttcaaaaatggcctcggcaatttctggcgaggtgtggcgcaagctggcccattcgccaacatgatgtgcttttgcctgactattcgacatagcgatctcctttaggaagatgagtccttaagttttgttgccagcccggcaacgtgttcgccctgaaaacgagcaatgatcaattcttcttccgaaggctgacgcgaaccatctccgcccgccagcgtggtggcaccataaggtgttccgccacggacttgcgaaatatcgaacatctctttggtgccataaccgatgggaacgatgaccatgccgtgatgggcgagggtggtccagacagaggtaatggtttgttcctgtccgccgcctgtaccagtggaggcaaatacgctggcgattttgccgtagagcgccccggatgcccacaggccaccggtgcggtcccagaaggtgcgcatctgaccagacatgttaccgaagcgggtaggcgtaccgacaataatggcgtcgtattgcggcagtatctctggcgtggcctcaggcgcagattgctgcgttttgccgccgacctctgcaaagcgctcggcgtccatggtttcgggaatgcgcataaggtctacctgcgcacccggtaccttgcgggcaccttcggccacggcgttagccatggtttcaacgtgtccatacattgaatagtaaagcaccagaatcttagccattgatctctccggggggttattcaacacacccaaaagtatagaagagctttgagcaactgctggagagccgcaagcgtaacggtttaaaaaacgctgaaaatgggcttttggtggggttattgttctatttccagggcgattcttagtgataactctgtttctaaatgtaacttcccggctaaaaaatcactattttggttgttatttagccattttgacgcttgtggtatacgttttatgacgctatctgtgggtaacactcattagtcaggtatctgacagccctggcgaacccggctacgtaacagcgcatgctgagcgagccaaagtagtcagatgctgacccgcaatggcatgttgaaatccttgacgcgttcgccccgcaggaacaaagcctgtcacgacctaatgcaacaggttgattcgccgtttgctggccttcattcatagcccgatggcggatgagattgcattacccggcatcacttaccacaatagcgcctgaatcaaccaggcaggtgaactatgtcggatacgacgcgcagactgactctgcgcataacgcgtcaggaatgggtacttattttcattacggttatctggggcgggacttttttagtggtgcatcgggcgatgcagcattccggcccctttttctttgtcgggctgcgttttgccacggcagcggtattactggcgctcttttttcgccgtcatcttaccgccatgagtggaagcgaaatcaaggcggggacgcttatcggcctgaccatcgccggtggttacggtttacagacctggggaatgcagaccatttccagcagccagtcagcctttcttactgcgttgtacgttccggttgtgccgctcctgcagtggttgtttctgcgtcgaccaccccggttaatggcgtggttaggtattttactggcattttgcggtttaatactggtcgcgggaccgcaggatggacgcgttacgctgaatcagggcgagattgccacgctgctcagtacgctggcgatcgcgggcgaaattatccttatcagccgctttgccgggcatgttgatgttcgtcgtgtgacctttgttcaactcacggtcgcttcactgtgtgccttctgctttatgcttcccaatggagaaacgttgcctgcactgtcgacaccgttattactcagtgcgatcggcctgggcgcggccagtgcactgatacaggtgacgatgaactgggcacaacgtagcgtgtcgcccacgcgggcgacggtgatctatgccggagaaccggtatgggcgggcgtcgttgggcgcatcgcgggagaacgtttacccgccacagcgatactcggtgcggcttttatcgtatgcggcgtaataatgagtgaactgcgtttaaaacgccgcaaagcgtttcccccttcctccgcgcgggatgattgaaggcgacgaagggcagtgcgcaaaccgcctgaaccaatgcaccttctgctgcaagagccgcagaggcagggattcgctcggcgctcgctctctaagcgttaccgccctgtgctaacgcttagggaagtgtaccgccacaagtggcgtaaaatcagtgcgttgctatgatgcgtacagttaacgtgaaggggaaagcctatgaaaaaggaaacatcagtgcccacgcgccgcgcagtggctgttgcagccaaacggacggctattttggatgccgcactgagctttttttcccagtttggcattcacggtacgcggctggaaaaagtggctgaacatgccggcgtctccaaaacgaatctgctgtattactatccctcgaaagaagcgctctatatcgccgtgttaaaagagatcctggatgtctggctggcacctctgcgcgcactcagtcacgatcaggaacctctaagagccattcgtcattatattcgtctgaaactggaagtgtcccgcgatcatccccaggcatcaaggctgttttgcctcgaaatgcttcagggcgcacccttgctaaaaggtgagctggcaggggatttaaaaaagctgatggacgataaaacagcgatcatacagcgctggatagccgaaggccggctggcgggtattcagcctcaacacctgatttttatgctgtgggcaaccacacagcactatgctgattttgccagccaggtcgaagccatcacgggaagcaagctcagcaatcccctgtttttcgaagagacggtggagaacgttcagcgcattattattgaagggattcgggtgcgctaagagaacgcggccatactgaatacaggaacaaacaacggagtggcctgatggattctgtttcacaatgcgtactgggcgcatcagtcaccatggcggtgatgggacgccgcgttccggcctggcaggcagcccttgttggagcgatagcgggaacattgcccgatctggatgtctttatcgatcacggtgatgccatcagcaatatgacgctgcaccgcactgaaagtcacgcgctgctttatctgacgctgatttccccgttactggcctggctggtcgcgcggctttgccgtgcaggagcgacatggataacctggtggcctgctgtctggctggcgcttattacccatcctcttctcgacctgatgacggtatacggcacacagcttggattgccgcttaccgatcatccttacgccattggcagcatctatatcgtcgatccgctgtataccttaccgctgatcgtggggttatgtgtggcgttatggcggcgaagcgatcggggattacgctggaactgcgcaggtctggcgttcagttcggcctatctggtctggagtgttgtgattcagcaggtcgcagacggccaaatcaaacagtcgcttcaacagcagggcattgcgacgaataaggtgctggtaacgccaacggccttaaatacggttgtctggcgtagcgtgattatcacaccggaccgttatggcgaggcttactggtctttgctgtcgcccggtcgccctgtgaaggtcacatggcggccacgtcatcctgcgttattttcatcatttaaaggtaacgcgtttgcagaacgtatcgcctggtttagtcacggcttttatgccatgggcgagcatgatgggcaggttactatcgccgatttgcggatgggggaagataaccgctacaccttcacgttcggtttgggcacggcacaacaaccggatgctcatccgcaacgcctgccgaccactgaacgcgggttaaaacgcagtctcagtcatatcgctgatcagctataaaaaaagcccgacacgtgtcgggcttttgcgtttttaacggcgcttaacggtgtttgcgtcggcgcagttgccagcccacggccagcaagataaaccacaatggcgtcaccattaatgcctggcgagtatcgtcctgtagcgtcagcaagaccaggatgaacacgaagaaagccatgcaaacccagcacatgaatttacctaacggcattttaaagttcgaggccgcatggcgttccgggaattttttgcgataggccagatagctgcacaggataatggtccagacgaacataaacagaatggcggaaaccgttgtgaccagggtaaataccgtcatcacattggggatcagataaatcagcgccacgccgcacagcaaacagaagcaggaaaagaacaggcccgtcgtggggacggcgcgtgcggataaacgtccaaaagcacggctggccacgccctgttgtgacaggccgtacagcatgcggctggtcgagaaaatcccgctgttggcggatgaggcggcggatgttaataccacaaagttaacgatgctggcggcagcgggcagaccaatcaggacaaacatttccacaaagggactgcgatcggccatcacctctgtccatggcgtgaccgacataatcaccatcagggccagaacatagaacatgatgacgcgtagcgggatggcgttaatcgcacgcggtaaaaccttgtgcgggtcgtgtgtttcagccgcagccgtacccaccagttcaatgccgacaaaggcaaaaaccgcaatctggaaaccggcaaagaatccgctgagtcctttagggaacataccaccatgatcccagatattactcagggatgcagtgccgccacctggcgaagggtagtgcatggaaaccaatacgatcccggtaataatcaacgcgacgatggccacaattttgataatggcgaaccagaattccatctcaccaaacattttcaccgtggcaatgttcaacgccaggaagacaaacacgcacagcagcgcactcatccagattgaaaagccggggaaccagagctggaaataagcactgatcgccaccacatcggctattccggtgactacccagcagaaccagtatgtccagccagtaaagtatcccgcccacggcccaagtaggtcagctgcaaagtcgctgaaagatttgtattccagattcgacagcagtaattcgcccatcgcgcgcatgacaaaaaacagcataaagccaatgatcatatagacgaagatgatcgaaggtccggccaggctaatggttttacccgagcccatgaacagacctgttccgatagcgccaccgatagcaatgagctggatatgccggttatgcagattacgccgcaaggtgtctgagccttgtgggctctgcgagtgattagattgatcaaccatgaaattgtctttcctgtcttgatgttgtgtcagctctgatggctgttgaggatgactgcctgaaataatttggcataagatagaggaagtaggaatgaaaacggtaatgattttttaacaatatcagacaacattctcatcaaagcggcatttttgtcttatgcaggcgttttttacgtcagattaggtaatctttcatcaccttgtgtcatcggcagggcagacaaggcagcgcgcttctacacttgctcattattcttcgtttcgccatcagaggcactatgcgcacgcttgtcctgcttttcgtattgatcgggctagggtggatgagtctgccctggttgaaagagcatttacccgcacagtttaatccgtttacgcccctttcggtgaccgacgcacctggctggatgacgcgcctgaaattaaagcggctgcaaaatgatcccgcagcctgtctggacgtgatgcgtcgcgcagagcagtcgggattcgttaactttcgtcaacctccgcccattaccggccggtgcccgcttgagcatccgctccgggtgcaaaaatttggcaccgtttctctcaacagcagttttctggccagttgtccgatggccgttgcagcgactatgtatgtcgttcacagcagtcagcagattctgcagcaatcgggcagcaagctggcgggtattgagcatgttggcagctatgcgtgtcgcaatgtctatcatcgtactcagggaagattaagtgaacatgccagcgctgatgcctgggatatcactgcctatcgactgaccaatggtcaacggctggtggtgagtaaaaactggcagcaacccgacgataaagccttattgcttcatggattatggcggtctggttgtgacttttttggcaatgcgcttgggccagattataatacggctcatgccacacactttcatttaggcatgcgcggagcgggtttctgcagatagtgtgctgacgaatgccgatgctaattgctgattttttatttttaataaaatgcattatctcttttttcggatgaaatcgttaatgattatattgatttctttttcttatatttaaaaatatactttccgtcgcagcttttttgtgtgttacggtcgtgctgtgatattgatgaagatgaaaaagcgtcacagtggtgacttgttagttgtgattaacaattacagcttttcctgatagttgatatcttcttttttctttaaaataatcgctgccggcgtggatttcatatgacaataataacaggctattatttcaataaaatatcctttctgttaaagctgcacgttaggttataaacacagtgagagcctgacaggcttattaatgttgtcgggcattctgccttcccctaatgtgaggcttcccactaaaaccctgacccgtagcatcgccagcaggtgtttttgcgcgccggtgaatagtttttagccagcctcttcttgtctcagtacagtaaaaaacagcgctctgggtttggctgttattaggggcaataccacgttttgggcttgagtgaaaactgtcctcagtcaggctgatgcggaaaatgtgtacatgcatttgcgccgatgtcatagcgccctcaggacggataataagttgcggatcgtaacttattgagtattatttcttaacaggcgccgtgttaaaagattgaaaaaatataagaaaaatcttattatttggtctgttgcgagccactcaaatcgcctgaggcattcctctacactctgttttcacctttttgcctgtaaaatgacctgaagagtgtatgaaaataaagctttttatgatgccatgacacagggtaaattatttttgttgaaaaaatatcaagcatgcagtgggatttgaggcaatatgacaagtgaagattatttttcctggcgggctgaaactgaaaataaatttcaggcattagccacgacccaagaattaaaggggcttttgcaggattatatccagtcactgggttttgattttttcgcttttttcatccagcaccgcgtcccctttacccggccacgcgtttatttgcacgatacttatcctaaattatggattaaacgttataaagaacagaattattatgccatcgatcccgtgctacagctttgtcagcgctcaggaagaggggtcgaatggacggcggaactgtttagttgcgcaaaagaaatgtggcaggacgcatgtaattttgggctactgagcggattttcgtgttctgcaatggcatcaaatcgagccgttggtatattatctataggatcaaagcgtccctttattactgactgtcggcgagttgagctcgaggccaggctgcattttttggctgaacaaagcttatacttgctcgaacgcctgaatgatgaagcgctgatggttcagggaaatgattttagtcagcgtgagctggaaattttgaaatggactgctgaaggaaaaacctcacaagaaatttcagttattttatcgatctctgagcacaccgtaaatttttaccaaaaaaatatgaaaaaacgttttaatgtttctaataaaactcaaattgcctgctatgccgcagcaattggactgatttaaatgaaaagcaactgccaactttagtagttccctcgttgaggtcacttgtctaccctgcgctgatgcgttcttgggcagacgcaaagaaatcattgcaaacatggggatgtcagaggcgcatgatgaaaatagttcaaacgcaattaaaggatatgccatcctccttgcttgccgagcttggcagttaccgttacagcgtgtttgcacggggtgaaggttggtcgattccaccgcgtctgagcacgcctggtcaagagtatgatcgttttgatcgctctgatgtaacctggttgattgcatggagtgtgcgcagtggcatcagtggctgtgcgcggttgatgccctggactgaacccgagcaaaccgagggtatcgtattaccctttaatcatgaaaaggtatgggagatgtcgcgtttctcggcgcggctggaagtggaccctgagttgccgcttaatattctctggcatgccgttcagcttgcagagcttaacggtattgaatttattatcagttcggccacgccaatgctggaaaaaatgttcgaacagcatcaggtcgtgtatcagccattaacgccgggtctgattcagtctgaggacaacctttttgccattcgtattccggtcacccagccggcactggcagaaaaatatcgcggtacacgacgattcagcccggaagaggtgcttccttctctcggcgtatcggttaactggcatccgcatggttagatgtgtgcccccggatacgggggcagcttagcgttactggcgataggcggctttgatctgtttgatggtgttgctaaacacttctgcctgcggcatgtcacctaaggttttaacgtagcgttccatatttataatcactttaccggcatctgcctggcccattccttttagaatcaatgtgatcatcatcttcaggcaagccacttcatcggataatttttgcgtttcctgcgaggtagcgaaatcttcatcgctcatgaatgtctccttggtggttaacgtcgtcttttcaatctgtacgcatagcaatccgagagtatatcacaggggatacagcttgctgagcgcatcacaaaaccaaggatgccgcctccgttttgttcaggtaaattaataaataacggacgggaatagttgagggtgatggcgctgagttttgtgaaaaaaagtgctatttgaatcaattagatattatttaacttattgaaaatgaatattttttaaatttttaatcttgtcagccattttctcatcgctgtgaaccgatctcccgccatatgagatgatataaatcattgaatactttccttacatcaccttgtatatgggcttttaatgcaaaaacgggtatgattgccgcttgcaatcgttaaatgctacctcttaattagctgcggagtgcttcgcgttgatcactgtccttcttgtcgatgaccatgaactggtacgtgccggtatccgccgtattttggaagatattaaaggtctggtgattgctggagaagcctgttgtggcgaagatgccgttaaatggtgtcgtgccaaccaggtcgatgtcattttaatggatatgaatatgcccggtatcggtgggctggaagccacgcgtaaaatcgtgcgctacaatcccgatatcaaaattatcatgctcaccatccatactgaaaatccgctgcctgcgaaagtgatgcaggcgggtgctgcgggctatctgagtaaaggcgccgctccgcaggaagtggtgaacgcaattcgctcggtcaaagcaggccagcgctatattgcatcggacattgctcaacaaatggcacttagccagattgagccgcaaaaagccgaatctccctttagctgtttgtcggaaagggaattgcagattatgctgatgatcaccaagggacaaaaggtgacggaaatttccgagcagcttaatctcagtcctaaaaccgttaacagttaccgttaccggatgttcagtaaactgaatatcagtggcgatgtagagttaacgcatctggccatcagacatggcctgtataatgcggagccgttaatcagtagtgagtgacctctttaatcctaaaatttttctgagtacggtcaccagcgagccaggtgtctaccggatgtatgatgcctccggaacggttatctatgtcggcaaagccaaagatctgaaaaagcggcttacgagctactttcgtacgaacgtaggcagccgaaaaaccgaagcgctggtgagtaacattcatcacattgatgtcaccgtaacccatactgaaaccgaagcgttgttgcttgagcacaattacatcaagctctatcaaccacgctataacgttctgttgcgtgacgataaatcctatccctatatttttctcagcagcgatgcccatccccgtctggctatgcaccggggcgcgaaacacgcaaaaggggagtacttcggtccttttcccaatggctatgccgtgcgtgaaacgctggcattactgcaaaaagtctttccgattcgccaatgcgagaacagcgtctaccgcaaccgtacacgtccctgtctgcaataccaaattggtcgctgccttgggccttgtgtagccgggctggtcagcgaggaagagtacgcacagcagacggattacgtgcggctgtttctggcaggcaaagacgatcaggtgctgaatttactggtcaaccgcatggaagatgccagcaacgacctacggtttgaagaagcggcccgtctgcgcgaccagattcaggccgtcaggcgcgtcaccgagaagcagtttgtgtcaaaccaaggcgacgatctggatgtgattggcgtggcttatgacgccgggatggcctgtttgcatgtgttgtttatccgtcagggtaaagtgctgggtagccgaagctattttcccaaggttcctgccgataccgatctggcggaagtcgtgcaaacgtttgtcgggcagttttatttgcaggggagtgagatgcgctcgttgcccagcgagattttgcttgatttcaccttacctgagcgcgaactgctgtccgagtcactgacggaattagccgggcgtagagtgaatattcaaagtaagcctcgcggtgatcgtgcacgctatctcaagctggcacgaaccaatgccggttcggcattaaaaacgcggctgtcccagcactcgacgattcatcagcgtctgacggcgttagccgagtttctggagctggataagattagccggatggagtgttttgatattagtcataccatgggagagcagaccatcgcgtcctgtgtcgtatttgatcaaaacggccccctgcgcgccgactatcgccgctacaacattaccggcattacgcccggggatgactatgccgcgatgaatcaggtgctgcgtcgtcgttatggaaaagctatcgaggaggacaagattcccgatgtgattctcattgacggcggaaaaggtcaactggcccaggcaaagcaggtgtttgccgaactggacgtttcctgggacaaaacacgtccgattttactgggcgtggcaaaaggcagcgatcgtaaagccggacttgaaacgttattttttgaggcagaaggtgagggcgtttcgctgtcacccgacgcaccagccctgcacgtgatccagcatattcgtgatgatgctcacaatcatgcaatttcgggccaccgcaaaaaacgagctaaagtcaaaaacaccagtgcgctggaaagcattgaaggtgtggggccaaaacgacgtcagcagctgctcaagtacatgggcggcctgcagccactgatgaatgcatcggtggaggagatcgcaaatgtaccgggcatatcgcatgccctggcagaaaaaatctactactcgttgaaacactagcattgaaacagggtgggcaatgtaggaacatatgccaaacaccacccaatccagacagttaccagcatatgcaatttaacattccgacctgtcttaccctgtttcgcgtcgttcttattccgttctttgtgctggctttctatctgccgttccactgggcgccattggttaccgcgttaatctttattgtcgcagccgtaactgactggttcgacggctttctggcgcgccgctggaagcagaccacgcgctttggtgcgtttctcgatcctgttgccgataaagttatggtagccattgctctggtgctggttgcggagtactttcacgcctggtggatcaccctgccggctgcaacgatgattgcgcgagagatcattatctctgcgctgcgcgagtggatggcggaaattggcaaacgcagcagcgtcgccgtatcctggattggtaaagtgaaaacgacggcccagatgttctcactttttgccttgctgtggcgtccggacagcatggtcgtcggcgtaggtgttgttgcgttatacattgctgcagtgctgactttctggtcaatgttccagtatttgagtgccgcgcgtggggatttgctcgaaccgtgatcgatacgatttaaaaagcagcaaacggacgcaatgtggggataattttattgactcatcgcgtcatctcagtagaatgcatcgcatcgaacggcagcactgctgcagaagctaagaaaaatcagtaagttcgatgaaacgtagtaaaaatcgaccccttcagcaggcagcaaactgaatggtgagatgatgcgggaatagctcagttggtagagcacgaccttgccaaggtcggggtcgcgagttcgagtctcgtttcccgctccaaattagcaggtcaggacaacctggcagcatatcagttttaggcgcgttggcagagtggctatgcagcggattgcaaatccgtgtacctcggttcgactccgggacgcgcctccagttatacctcgcccgggtggtgaaatcggtagacacaagggatttaaaatccctcgatcgcaaggtcgtgcgggttcaagtcccgccccgggcaccatattgaaacaccaataaaatcaagtagtagcaatgtcgtttaagccgcctctttgggcggtttttttgtgcctgaaattcggcagtggcagcaaaatggcgatgacttggcgatggcatttttataatctgtctttagacggttagacagttttacaagcgtttgcaaaagtcagcgtccgagcgtcagtaaactgagcagataaacttatgatgtaaaaatgatctaaatgattaccgtaaggatctgactgacgcaggcggctttataatttacagatgtttgtgtctccggcccaaaagcgggaggctagggtgcataagaaagatgataagaacattgcaatcttttgcacaatacggatcgaggtggttgtaattttacagcgcacgtatttgattcgagctaacaaacctcgaatgagccatgctagccaaacgctgatgtattcaaaggaaaaataatttatatttcattaggttatgcttaacaagcagcgtttatagttttaatgattttatagtcagcgtaagtgtgaaaactattaataaaaaagttaagataatcttctttgaagatagtcatttatgtcggaaacatggaggtaacgatgataagttcgcgaaagctggctgatcaaatggcagaagctattcacttggacagcaacatgtttcgggggtttatacagggatttatgagcttgcccgtcgatttttattacctgggcaatgatttcttccatactgatgatcgatatgtaaattctcttgataaagaaagacttatacgattagtaaagcatgggatggcgtctaggcataatcttgaaaaagttattaaaatttttatggataatttttttcaacacgttgatttcactaagatgaaagagatttccgctaagggaggcgggaattttgttggccgcatgacattcaaccaattggctactgccaacatgggttatcttttctcttcacgtttaattcctcgtattgcctccgggctaactatcggcagtatcatgtctctaggggctgcaatgtcgcgtgcgatttacgtatcgagagatttacaacgaagaaacccttcaatctatgacaccttaaggcgcatgggtgatatggatctcctttattttttagtggctgataaaaccagaccctttgaagacgctgcacagctttgggtaacagatagaaaaaaatttcaccaaacgtgctgctttttttttgagaaagtaaaaatatgaaaaattttctgcttgctgctatatctcgcattgttcaaggcatcggtatcggcatatgtggtctatcgctcatctatgtgggttggtatttgtttttttctcataacgtatacaaatattaccttgccgtagcgagtttaatggggctggttattgggtactatatctttaagtttgccgtgcgaaaaatatacgatgaaagccctggcgactggtgattttcgtggcggtaaaaacaaattatgtagcagtaatgcgctggcatagttacgttaaaagtcgctatgtatcatgagattatgattgataagaagcctcaatagcttttaaaatccctcgatcgcaaggtcgtgcgggtttaagtcccgcccgggcaccatattgaaacaccaataaaatcaagtagtagcaatgtcgtttaagccgcctctttgggcggttttttgtttttaaagtcccacgtcctaatatgtcttcataatatatcaatcctgtttctgacctccgacaaccagcaaaacacgttcttcctgttgtaacgtgcggtttgtttcacgttcttatgccctgaaatttcctgtttggtataaatgttgccatcgagatgcgatataccttttgcttgtaagtcacgaaaagtgaaattgaaatctggtccaggaaaagcagcttttgcttcttgcctggctttaagccagagctgttaaaaccatcagatagcgctacagaaacgatattggctatgaactgatacacattagtgatttttcacattttttataaaaaaaagttcaaaagataggttcaaggctcaccatgtcatggatgttgagctaatctattaattttttttatgaaatgaggcgctcatgacttgtttatctgttgctaaaactatctacatcaacaatgtggacgataaatacttcaagtacgaaatcattcaggacgaagctggtgagattgtgtttgctgtcgcgtttatcgaggccattattgagcatgatgggttaagcctgcctatgtggacgaagctggaaaacattaccgttgatcacctggtgccccctaaagatggcgggtttcagactgaagtaagagatcatccttattctgggaagtctatggggacagtgatcgacgtatgcaaagaacatcgaaaaagatacaagaattaaaccagggtttagacgtgaactgcaccccaacagtttgacacccaactgagtaaggtgcagttttttatgagcaagtaggttctcagcgttaaggttcaggtcgcacagcattatcttcacggcgtggaagggcataaggttacggcaaagcgctttggtatcgatcacagagccgttcgtaaatggtctgctgcatggaaatgtcgcggtggaaggcttagtcaggctgtgccggaacggaaacggaagacactggtgcgaggcgttaaggataaagccagatgcataaacgacaacgtttagcgtcagcaggagtgaaccagaaaagcacagcagccgtgatgccaggaataaaattaattgttcatttaatatgctatgatgcacatccgtttcacaacttaggcacacatggacgactatgatgaacggccctatgtcatcttcaccgctatcggtaaagccgtactagaactgcttgatgtgcaagataatttttttgatttggaacttgctgaaatacttgaagagtggatggaaaaggaaactaatccgcttcaggctgaggtctacagaatggcagctgaatttgtcagagcaggcaaggcaataaattaaaaaggcctgcgttacacaggcagaaactgttacaagggaaaatccagcagtcagtctcgactgactgtgcaagcatacagtgatcctgtcttttagatataactgaatgacttttgatcagtaaaaggcacgatgtgcatgcggcaggcataaaaaagcccactcggatgtgggcatagcgaaacgggctataaatataaggtactatcaattacattttgattatcggcaggaacgttgaaatcttaagcctcagaccataataaaacgcgagatgacgatgattttaactatttcctataatttcaagttgttttgctatggatatgtgcctcaagtatcaccctgagcccctgagcccctgagcccctgagcccctgagcccctgagtccctgagcccctgagtcccgacatcccctcttgacgccatttctctttctgtctaaaaaaatctgattctgatgtatgtttcagtacactcatcacgttcgcattgtggagcgttacgccgaggtctgtggaccggccctcagctgttcctggcgtgctaatcaggtcgtgacaattttctgctaataacgcaaatgcttcaattgcagtacagcggcaggatcgcctatccattccctgttttattattggtattacgtttttcgattgccgttgcgcgttcacatctcagtcattcaggtttcactccacgttatgcttatcgttaaatcatccaatggaaacgaaagttgatcggatcaacgcctgaccttacaacacctgcctgacataatttcttcaccacgtaatgtagcgccgaaaccggtttaaaaaagccgcaaacaaacccactagaagaagcgtgaggttggtactttgcgtcatgcctgccaatcccagtgacgtgctatcgatagccggacgtatgtccgtggcaatcgcataagcctgaatgcagtatgaaatggagcgcaaggtccgtgtaatgcagaccaaacagtgctcaggcattcacgtcaaattaaactggagtcacaacaatgaaattcaaaactctcatcgcattaagtttagtatcactgtcgtttggtagtcaggctgcatcttttgtcgtagatgcaaaaaacaactgctttgatcctgaagctgttaacagcaaagttcaaagcggttcaccactgaaattcaatcttgatgcgggtacatataacatttacctgacctcaaacagcgccaattgtgcttctggcacgtcttgtcagattgaccacgtaaacatggctggtggaatgagcacggcaaggtggggttcttcgatcagcagcacttcacaacagatcaacgtggctggaagtaattattatctcatcgcttatattggcgataacaactgtgcggataatacaggcactgtgaccattcaggcggataaaattcagtaaagaacagattttcctccttatgagagactatcttaagacgcattttcgaatgcgtctgctaatcgtttctttacaggagttttccctatttatgatgaacgacataaaattcaggtcaatctcatgctgattttcagatcagaataggggagtgtgggggctgcttatctttacttttcacgagcgaaggtttctgtttaccaaggtaagatgcagatattgggaatgatgcatttattgtggctttcgatgcactaaccttatcataagtcgtttttaccagtaaaagataaggacaggccgtgcccggacatcaagcagaaatcgatttcggttcagaccacatcataatagaacgtcgctaccgcgcccttggcgcactcaacgatctttttatcgccatctggtttctgacggggagcattctttttttcttcgattcgctgatgaccggcggcacctggttatttgtggtcggcagtcttcagttgctgttacgtccggcgataaccctggcggaactcgtccacgtcaggcgcgtttatcgctcacagtcagtaaatcaggaatgatttaaggccgttttcctcagcctgaacacttctcttcaggcaaatcagcctgaccgtatggttttacgctgcggtcaggctatgcgtgatttagagataaattgtgtgatggtttgctgccggattaccaggtgcgcgctggcggcggtggcgtctgttgacccgtggtaggcggtggcggcggtggcgcttcagcttgtccgggtggcggcggtgcgaatgcctgtcctggcggtgcaggaggcggtggcggaggacgacgatcgtgcggtggtggtggcggtgcagcgcaacccggacctggcggcggtggcgcgcaggcggtgagcgtggatgttacaaaaacagcagcaaaaaaggtcagacgacgattcatgctatttcccttatgaaattaacagtaagctaattgtagatgaccgttattaaaaatagggtggctggggataaaagcgaagcgacgaagcccatttgtttgttttttgagatacttctcatctcgcgacagtgatccggttttttgccacaactcccgctaaggtagcgcatcaataaagaggagtgatgttatgaatggcattttgaaattcgtccgaggctggctgattttttcggttctgtggggcgtcttcatgtggtttatgtcatggcagcagcagggtaaagagattgggctggcgattttaatgagtctttatgccgggctgctttatcaggcgctgatcaccatggttgcccgctacagagcacggcggcagcaagcctgaccgtcggcctgctgcccggaagcagcaggccaggcacttagcccagattgccggttaagcgccgatgaaagtcgctgctacgcatatccaggccttcaattgtgacctgggtgccatagcgctggtaacggtattcgatgccgtcaagtgccgccacggtcgatgcatcccagatttgtgcatgggttaaatcgatggtgacagattgcgggtcgtgcgcgtaatcaaagtgctcaaacaggtcgttgctgctggcaaaaaacagtggtccgcgcacgaagtagcgcactgattgcccatcttcgcttagctgtctttcggcatggattacatgcgccacgcggcgtgcaaataacagcatcgcaacgataacgccagccagcaccccgagagccaaattacccgtcaacaccgttatgccgaccgtcaacaccatcaccagggtttccgaccagggcatccgtttcagcgtcgcaggttgcaggctatgccagttgacggttttcacggcgacgaccatcatgattccggccagcaccaccatggggattttagccataacatggctcagaccggtgaccagaagtaacaggaccaggcctgcagccaccgtcgaaacccggctgcgcgctttgcctaattccacgttaacgatcgtctgcccgatcatcgcacatcccgcgattccgccgtaaaagccagcaagaatattaccaatgcccagtccccatgattcacggcgtttgctggaaggcgtgtctgtaaggtcatcaactaacttggccgttagcagcgattccatcagaccgacaaacgcaatactcagggcggtgggccagatgatctgcagcgtgtgcagatcgagcggtacggctaaggtcgtgaaatcgggcagcccggcactcatcgggccttcatctcccacatcaggtacgcgatagcccatcaacagcgccacgccagttacgacaacaatggcgaccagaggagaaggaacacttttaagcacgcgtggcagtagcagcacaatcgccagagtgacggcgaagagcgcccataccaagggtgactggccccagacatgaggcacctgggcaaagaaaatcaaaaccccaagggcattaacaaaacctatcatcacggaacgtggaatgtagcgcatcgcccgggacatgcctgtcacaccaaacagaatctgaatcagtccggccatcaccaccgcaggcaggatataggccacgccatgtacatgtaccatcgggccaatcaccagcgccaccgatcccgctgccgcggtcaccatggcagggcggccgccaagaatggacagcgtcaggcaaagcaccaccgaggcgaacaggctgactttaggatcgacacccgcgataacagaaaacgagatgacttccgggatcaatgccagggcggtaatcacgccagccagacattctcgggtaagcagtgcaggcgaacgcaatacgcgcctcacactgatatcgttttccacaaccgcagcggtggcgacatcattttgttgaatcataatgttgtgcaggctcttttattttcatcttgcgcgaaaggcaaggcagactggatataatgaggggcagatgttaccgatcgataaacgaagaagccagagaaagagaaatgactccatccatggagcagggattataccgttaagtcgtcaggtgttttgtagaccaccagctccagcaggtgacgataaacatcgagtgaaacttcgtcacgttccagttcaagacgatgaatcagtttagaaataatcgctttgttattaacggccatccctgactgcagaatttctgcgaccaccattccaagaatttccatatcactgtcaggcttatgtgccgcaacggtaaaatattcagcaatctctttatcagtttggggcagtgtgttttgcatgtgttagcctttcaaatagccagctatccgggcggacagcaggacaaacagacctaaaagccatcgcataaaatacaatggaacccaacgccgtaaacaggtccagatggtcaaaaaagaaacctctgagggtggaaatccattacaccttcagaggcgacgcagatgcatcattcgttacagagtcgtgatcacaactcgttggctgtaaagttatacaatgaaactttaattgtacaagtaaattattagacaaaaaatgctaacgcctattaattaataggttagataatttttttgcaggcaatgtgtacaacaaaatgtgtacaaactaacaatttcttcacgaaaacagcattccccgacagcgttaaccaaacagattgagttttgccgtcagcttacgcacctttttcttgtcaccgactaccgcgatacccagtaaacgccattctgccgccggcagtgtcttcattgcggccgtgagcgcgccgtaatccgtggtcgactgaccttcttccgggaataccacaatgtcgcattccgcctcttcagcctgatgccataaggcactaagctggtgtacatctgcagccagcacgggaatacctacgggaatcagaccgggaaagcgccgcgtggcggcatcctcaagggcttcacctgtcagagagggatgacgctggcccaccgtcagggcgatgacggctgcggcatttgccgctttgcctgtgggtagcgcgctgttcaatatcattacacatcgtgattctgtcatgttcttctcctgagacaaaaagccattgtggcaaggctcttttcaggcgtctggaagatttgtgcacagctgctggtaacgggcgggagtcagttggcaggcacgcttaaaccagcggcccagatgactttggtcggcaaaacccagttcggctgcaacctgtgcaggcgattcaccgatagccagccgacgtcgtgcctggctgagccgccactgtactaaccaggcgtgcggcggtaagccccattgctgctgaaacagccgggaaagacgaaagcgatcaacgttgagggcctgtgccagctgtgcaatcccgggattgtccgcgtgataagcgatcaaccagtcgcgagcctgatgcgccagcgacagagccgcatccgttttcgcaccatgccagacaggatagtgacgaagttgccggaataaacggtccagcgccgcatctttaataagttggggatgatcgtgccacagcgcttcaaacgcatgccagactgcccaggaaagttgaccatcatcctgcagcgtggtggcaaaacgcagttctccgcaaggcgggccatcaagacaggcgggcgcaagatgctgatgcagatgatgaggtgacagatacagcatacggtaggtaaagccctgcgcatcaatcgcatcgccatcgtgaagctcttcaggttccaacataaagacagtgccggggcgactttggtgacgttgacgtcgtgaatggaactgctgcaccccttgttccgtcacgccaattaaatagctgtcatgccagtgaggatcgtaggcatggccggtaaaatgcgcccgtatggattcaatgccgctgttcgggtcgcgacgtaaatcaacccagctgtctgatgaatctttcacacgtattttactccagaggacttttacgagagtatcaacctgaacattctgccgcgattatccattatttaacagattaggcacttttcattcgcaatttgctttgcgtataataacttattcaactaattagatctctaatcattaggttgctacttaaatgtcatctaaccgtacctttacgcatttactgcatcttaccgcccatgcctggcgcctggccgttgatcgtcacttaaaagacagcggattaagcaccagcagctggatggcgataggattgatcgccagcgagcctcagcggcttacgcaaactgagctggcgcagcggatggggctggaggatgccagcatggtgccgctaatagaccgcctggtgaaacaggatctgctgatgcgcgtgcagcccgttgaagatcgtcgcaaacgccatctggttctgactgaaaagggcaacgaagcctttatgaatgtcaaaacgcacgccgatgcattgcgtactgaattgctggctgatatcgatcctcaggagctggtgattgttgagcgcgtgttagagacgcttctgacccgaatgggaacgatgtaattatggcccggcgcaatccctacgctgcgcgtgaatggttgccacatgaaaaacccatgctgccggggtcaccttccaccccgctgcattcaacgcctaaacgcctggcatttggcttaatcggcctgttgatctccctgacaggtgccttaagcaatgcgctggtcagcgccaatctgacgaatctgcagggcacctttgcggcttattcgaatgaaatcgcctggctaccggcggtgtatgtgatggggaatatctccatcaacctgctgctggtgaaatttcgccagcagttcggactgcgggtgtttaccgaagcttttctggtgctttatgtgctcgtcgcctttttccatctttttgccaacgatctcagctcggcgattattgtgcgcacggcacatggcatggtgggggccgctttgagttcgctgggcatctattatcaggtccaggcgtggccggcgaaacatcgcctgaaagcgctggtcatcggcctgaccgtttctcagttagcgattccgctggcccggctcttttccagcgaattgctccagcttgacgagtggcgcgggctttacctgtttgagctgggcttagccctgattgccctgggcgcagtgctggtggttaagttgccgccgggcgatcgcatcaaggcgttcgaaaagatggatttcgtcacctttatgctgctggctccgggcatggcgctgttgtgcggcgtgttgtcgcttggccgcattgaatggtggtttagcacaccgtggctggggatatgcgctgcgctggcattagtgctgatcgtctccgcatttgtgattgagcataaccgccgcaatcccctgatcaacacgcgctggctcagcaacgggtcgatcgtgcgtttaggcattgtgatgatcatgattcgtatcgtgctggcggagcagaataccggtgcgataggttttttacagcagatgggtctacagaatgatcagatgcacggcctggcctttgccattatcgccggtgtcattgccgggattgcagccagtgcgctgaccattaaacctacccatcttaactggccgattgtggtgtcgctcatcgtgatgatcatcgcctctctgatggatgcgcagtccagtccggtcactcgtgccaataacatgtacttgagtcagtttttactgggatttggtagcgccttttttatggccccggcgatgttgatggggatcggcagcgtagtgacccagcctaaaaacctggtcagttttgtggtgctgttcggcatgagccaaaacctgggcggcttaatcggctcggctattctggggacctttcagacgtggcgtgaaaaatatcactccagcctgctcggcgatcaattatcgttactggaccccaatgtcagcgaacggcttaatcaatatggtgctttgtttaacagtcaaatcagcgacagtgcgctgctgagtgcgcaaagcatcagccagcttcagtcagtcgcaaccttacaggccaacgtgctggcctataacgacacctatctgctgacggccgcgctggcgctgatcaccctgatgtgggtgctgtggcgcttaacccgccggcgctatctcgactggcgacaggccacattcaatctggcagagcagcgtcagcttgccgccgcacaagaacgaacggagcaataatgagtcagcaggatgaacttcaggcagcagagcgcgaccgggcaaatcgccgtcgtattctctccattgccttaggcagcggtattgtggtgattggcgtgctggtgattctgtatgcctggcagctctggcccttcaccagttccgtgcagagcacggaaaacgcctatgtccgagggcaggtcacgtttatcagcccgcaggtcagcggttatctgacggccgtgaatgtggttgacctgcagccggtaaaaaaaggccagttactgatgacgattgacgaccgtatttatcgtcagcgcctgcaccaggcccaggcccaactggcaatgaagcaggcggcgctgagtaataatcagcagcagcgtatcagcgcgcaggcaaccattcaaagtaataaagcggcgctggaaaacgccaaagcacaggcggtgaaaagcggcctggaccttaaacgtgtcgaaaatctggctgctgacggttcgctctcggttcgcgagcgcgatgcggcgcgggcggcaaatgcacagggcctggcgcagttgcatcaggccgaagcacaggttgccgtcgcccagcagaacttacaaacggtcattgttaaccgcgcctcgctggaggcggatgtggccagtgcaaacgcggcgctggaactggcagagatcgatctggataacacgcgcattacgtcacctgatgaaggacagctggggcagttatcggtgcgtaaaggtgcctacgtgacggccgggacgcgcctgacgtcggtggtgccgaaccataaatggattatcgccaattacaaagaaacccaactggcccatattcgtgccggattgccggtgacgattcgtgttgatgcgctggacggtaaaacattccacggtcacgtcgaatatctctcacccgcagcgggatcagaatttagcgccatctcgccggacaacgcgaccggcaacttcgtcaaaattgcgcagcgtattccggtacgtattgatgtcgcgccggaggttcagcagcagcttcgtcccggcatgtcggttgaagtcagtattgatacggctgcaagcgcagacggagaaaaaacgccatgatgggctatcgcgtagccgcaggcctgctggcgatcgtccttgcgggatgcagtacccaggtcgacaaagccccggcatctttgccgattccgccacaatggcgtgagcaggttgggccttctgcgccgccggaagcggcatggtggcaggcgtttggcgatccagacctcaatcggttagtaagtcaggcattacgcaataatccagacatattgattgcccgctcgcgggttgatcaataccgggcccagttgcgtgcagcccagggggacgacttcccgacgctgagcgggggcgtggctgcaacgcgtcagcgtgcgctgtccgcggcaaccggtcagcctaatgacacctccgtttttcagggacagttgcaggccagctacaatgtggatttgtggggcgcacgcagccgttcgatcgatgcggcgcaggcggcgctggaagcacaacaggccgccgcctctgcagccgaactgaccatcgccagttccgttgcatcgggttatatgacgctgtgcgcgcttgatgagcagctgcgcgttaccgaggacacactggcaacgcggagtcactcgctcaggctggcgcaacgccagttcgaaacgggctacacgtcacggcttgagtggatgcaggcgtcatcagaatatgaatctgccaaagcccaggtgccgcagctccagcaccaaattgcgcaacaggaaaatgcgctcagcatcctggtgggcatgaacccacgagaaatcgctcgccagcgcgaattcactgccattatgccgcaggtcatgccgggtgtgctgccttctgccttgctgaatcgccgtcctgatattgtgcaggcgcagcgtcagctactggccgccgatgccacgctggcttcttccaaagcgaagctgctgccggggattaacctgactgcatccggcacgctgcagagttccgtgttgcaccagctggtggacgatcccttccgcctgtggagtgtagggggcagtattctggcgccgttactgaatcgtgaagccttgaccgctcaggtcgatgtttccatggcctcgcggaatcaggccctgtacagctatgagaaagtggtgcgtaacgcgttttccgaggtgaataatgcactggatgcgatccgtcagggggaagctcagcaggcggcgctgcagaagcaggaacagtttgttgccgaggcgctgcgcattgcgactaaccgttaccaaaacggttatgcctcttatctggatgaactggatgcacaacgtaccctgtttgcaacccagttgaatctggtcacggtcaaaaataatctgttgcaggcgcaaattgagctgtatcgcgcattgggcggcggctggtctgctgaaaacgcggcttcgcgcgagccggtgaagcagtgattagcggtcaacgtattttggccgtatcgtctcctctgcgtaggtttgtaaaagaacggattactgaataagattgctctacactgtaacccgcaaatgtagccttgagtcacgtgttaaccaggaagagcatgttgttacccagcccaccagaagagcacgatgaacccgtggttcagccgcttgccgatgctcactttgcgattgtggtgcttgcggtgacgtcagtaacgctgatcatttttgttctgatcgtcacgctctggatgagctagtgtttatcaaccggacctgaaaggagtgagggatggaatcgagagatgataaactgattgcaattattggcttgctgacggcttgcctgatcggtgtcactttcttgtttgtggtgacgtggctaaacgacagccatcaggccccaccgctggaaggcgttgacacacagacctgctatcccaaacccccgtcgcgtcaggtctgatcgcgcttactgaattttatctgctggctccgcagcaccagtgccaggttctcatgcacggtgcggttgccattgggatcggccaggcccaacagtgaacccggcgaacgcctgtcatctgcccatgacgggtattccaccacagggtaaagcgaaatcccttccatagcaatgccctggtccagcgcgacggcaacgttttcactgacttcctgtaaccagctcgcgcgggcttcgccttcggcaccggtttcggctatcagcatcgggcgttggtaacgttgccagtactgggccaggagaagatgaagcggggcgcgtacgggatcgtctttatccatcggctgatcggggaagaaccagtggttatcgggatagtaattcagccccagaatatccaggcaatcttcgcgcccacccagttccttatcaagccgaccggctaacatatcccaggcttcaaactgcgcctggtgctgtgcatcagccccgggtttgctgtctggattgtcaggatgatgggcaatttgtaccagtggatcggtaagcacaaaacgggcatcagggatcacttcgcgaatagcctggatggcggccagggacgcgcgaaccagttgccgcttcagctctttaccgcgctggctggcatgcggattaaaccaggcaacgtctgcgcctgcccatgaccagaatgagatctggttaatgggggtgaaaaaaggctgctggatgccctgatcgagaatcacccttgccatttcccgggcataacgttcgaagtggtcgacaaagcccgctttccagatattaatgtggtcgggatagccaaagtgggccagttcccagataacctgtaactgattatcccgagccgcttcgaccatgggcagaaagctactccagtcatactggttgggtgttttttcaatcaggtgccagcgtgcgccgtcccgcgcggttaacacacgcaggtcgaccagcgcggcatagtctttcctgagcagcatatcgtgcccactgctgatcaccatatccagccgtttgcccggtgtacggcaggcggtggaacaggggaagctgccctgaaaaaaactctggaacaggcggggatgatggcgtaatcggtcgtcagttaagggcgggttactcatattcctctcctgccagacaaatctcagtcacagatcgttcgactaagtctagactaaaaaacgctgccatcagcatgcctgatgtgcaaccgacgctggcatacgctgtcgcgcggaggaataataataaatgacaggatgatttagggaatatccatgaccgaagcgtttgaactgccccagagcccatcacagcagagctggcttgaacaacggcttgttccactttgtcagcagcatccggggttgagcggtattcatccgctcagcgacggactcgatgcttttgccgcccgttttctcctgatggagaaagccgcgaagacgctggatatacaatactatatctggcaaaacgatatgtctggcaggctgctgtttagcgccatgctggaggccgcgaatcgcggtgtcaccgtgcggttgttgctggacgataacaatacgccggggctggacgataccctggcccagcttaatcatcatcccaatattaccgtccggctgttcaatccgttctcctttcgtaccttacgtgccctgggttatctcactgactttgctcgccttaaccggcgtatgcataacaaaagcttcacagcagatggcgtcaccacggtcgtgggaggacgcaatattggcgacgaatattttggtacaggtaatgagccgctttttgccgatctcgacgtgctggctatcggttcagtggttaacgaggtggcagacgactttgaacggtactggaacagtaaaccggtttcgccgctaaacgaggtactggaacagcaggcaacagagcatcctgacgtggtgctgccaccggaatggcgagacagcgaggcagtacagcattatcttgaccggctggatcactcttcgctgattaaccaactgacgcaggacaccttaccctttgtctgggcaaagacgcgattgttaagcgatgatccacgcaaaggactagggaaagcccgccgtaggtcactcctgccacagcgtatgctggaagtgatcggcacgccccagcgtcagtttgacattatttccgcctactttgtgccaacccgcgccggcgttgcccagttgctggccctaaagcgcaaaggtgtgaagattgctattttaaccaactcgctggcggcaaacgacgtatccattgtgcatgcgggctatgcgaaatggcggaaaaagctgctgcggcacggtatctcgctgttcgagttaaaacctcaggccgggctgaacgacgcgccgcacgatcgcggcttaaccggtaactccggttcaagcctgcatgcgaagacgttctcggtagatgaaaagatactgtttatcgggtcgtttaacttcgatccgcgctccgcagtgctcaataccgaaatgggactggtgatcgaaagtgaaaagctggccgccgacacgcaccagcggtttagcgactcgatgcgcgatcgcgcctggaccttacaactggataagtggggcagggtgaactggctggagtacccaggcgaggcgcagcaggtgattcacaagcatgaaccgggctgctcatggtggcagcgtttacaagttcgactcgtgtggcgcttacctatcgagtggctgctctaaaataaggcgatcgtcagcgatcgccttattttgttatcgcttctgtggtttaccggaaaacagaaagcgcagtacaggaacacgcaggtgcaactcatacaacgtaaatgagacaccaaacaccatcaccaggcccagcagaaagcccagcgtattattatgcagcactggcgtaacgtagatcccgtataacagcgtcaggggatggtgcaccaggtaaataaacagcgaagcgttcaccaggtacatgatgcgtggagaatgcgagttaagcagtttatgccccaggctgtaacagacgttcagcatacacaggcccatcatgctgctgattaacgcgtccagctcatacaaccagccctcaccgctgctcgtccgctggttgacgatataagccaccagcagcagcacagcgccgataaacagcaccggattcactcgcacaaacagctgttttaatgcctgatgtttccaactgagcgcacccaacatgaaaaagggcaggtaaaacagggtctgcatcacgacaaaattaaacagtgcgtcgcttaacagcgcagggtgagtgtaaaacacaatacgacgaaagccgccccagagaagacaccagaccaccaggccgagcgccagcttactccagcccacatgctgataatcaatgttacgcttctgatcgcgcagccagcggaaggttatcatccccaatgtggtaagaatcaacagcaccagtaaaaaccacaggtgcgagatcagctcccacatcaggttgttgaatttgtcgtaaaggggaagcgtgccccagtccgcgtactttgttgtccatgccttaagcataaaaaactgcggaagcgtgatgagtggcactgctgtcagcatcgggatgccaacccgctctaaacgcactttcagaaagcgctgaggctgatagcgcagatagagcatgtaagaaaagtagccggagatgacaaaaaagacctgcatgcggaacgcatgaataaaatcattgagggtggtgagccagagcgaggcttcgctgctgttaacggcccacttctgtgacgaatagatcagggaaacgtgaaacggcacgcccaataacatcaaacaggcccgaatggagtcgagaaaatattcacgctcagtttttattgtactcataaagttccagttcgttagtacgttttagccggtttcgccctgaaaccgtattatgtcggaaggaaattctagctgcagataacagagtttactatcagttgaatctcagttgagcccgtaacgtttaattgtcctaaaatcaccccctgagtagcggattatcgggaacattgttgcgcataagctgtcggaaagccgaattatccattaagataagcgggtttgtattaagcacacgaaagggggggatgtgctgactaaagtaaaaaataatgttgggctgacgaaaatgcgctggattggcgcggcagtcctgctggctttgtatgccaacaacagttgggcgtttaactttgatgatgtggctaaacaagccaaagatctgtctggaaaaagcttcgaagcgccaaaaagtaatttaccctctcaatttcgtgatatgaaatttgctgactaccagcagattcagttcaaccacgataaagcgtattggggcaaactgcgtacgccgttcaaactcgaattctatcatcaggggatgtacttcgatctgccggtgaaaattaacgagatcaccgccaatacggtacgtgaaatcaaatacagtcctgattatttcaacttcggcaatgtgaaacacgatgccgatgcggttaaaaaccttggctttgccggtttcaaagtcctgtatccgttgaacagtaagaacaagaaagatgacgaaatcgccagcttcctcggcgccagctatttccgcgtgattggtgcaggccaggtctatggtctgtctgcccgtggtctggcaatcgatactgcgctgccctcaggcgaagagttcccgcgttttaaagagttctggattgagcgtccaaaaccgcaggacaagcagctggtaatctatgcgctgctggattcgccacgcgcaaccggtgcttaccgctttacgattcacccgggccaggagtccacggtggatgtgcagaccaaagtctatttacgcgacagcgtcggtaaactgggcattgcaccgttaaccagtatgttcctgtttggccgcaaccagccatcgccagtgtctaatttccgccctgaactgcatgattcagacggtctgtcgattcacagcggcaacggtgagtggatctggcgtccgctgaataacccacgccatctggccgtgagcacctatacgattgaaaatcctaaaggcttcgggctgttacagcgcggccgtgatttcaataactatcaggatctggatgaccgttacgacctgcgcccgagcggctgggttgagccactcggtgactggggcaaagggcgcgttgagctggtggagattccaaccgccgacgagacgaacgataacatcgtggctttctggacaccggaaaacctgccagaaccgggcaaagcgatggatttcaactatcgtctgcactttggccgtaatgaaaacaaactgcattctgacgatgttgcctgggtgaaagatactctgcgttcagccggcgacgtgaagcagtcaaatttagtccgtcaaccggatggcaccgtggccttcaccatcgatttcgttgggaaagacatgagtgaaatgcctgccgacagccaggttgcaccgcaggtcagcgtaggtaaaaacggtgaagtggtggaacaaagcgttcgctacaatccggtgaccaaaggctggcgtctggtactgcgtctgcgtgttaaagataacaagcaggccacggagatgcgcgcagcgctggtgagcggtgacaaaacattgacggaaacctggagctatcagttacctgccaatgaataatctgacttttacacctcaacgttatgtagaagccctgccgctggatgcggcaggaaaaatgcgtctggctgcgtcactgcaaaacgcgcagacgtttcaccagttacacgaatcgctgggccgggatgtggctgccagcgatcgtcctgacgatgcacccttaaagtcggtatcgtcacgcgtggaaatggcctggtccgattccctcgctgacggccagcagttgggcaaggattatcttgatcgcaccacgcttaaggcgatgccgaaagtgaagcgttcattgatgttccccgaagcctggcgaacaaacccgctggcacgtgcctgggactcattacgtggccataagtctgtgccccgttatgcgacggtcgaagagcagcgcgccgaagaaaagtggcgtcacgttggctccattcgccgctatatcctgttgatcctcaccatcatgcagaccgtggtcgccacctggtatatgaaaaccattttgccttaccagggctggacgttgctggaccccatggacatgatcaaccagaactggcagcagtctgtcatgcagatcctgccttatgtgttgcagaccgggattttgttcctgtttgcgattctgttctgttgggtttcggcgggcttctggacggcattgatgggctttctgcaactgctcattggccgggataaatacagtatttcttactctaccgtcggggatgaaccgcttaatcctgagcaccgtaccgcactgatcatgccgatctgtaacgaagacgtgggacgcgttttcgccggtttacgggcgacctgggaatccgtggtacgcacgggtaatgctgagcactttgatgtttacatcctgagcgacagctatgatgccgacatcgccattgctgagcagaaagcctggatggaactggtccgtgatgttggtggcgcaggcaagattttctaccgtcgtcgtcgtcgtcgtgtgaagcgtaaaagcggcaacattgatgacttctgccgccgctggggcagcaactacagctatatggtggtgctggatgccgatagcgtcatgagcggggaatgtctgacggggctggtgcgcatgatggatgcgaatcctaatgccggtattattcagtcatcgccaaaagcgtcgggcatggatacgctgtatgcgcgttgccagcagtttgctacccgggtttatgggccgttatttaccgccggtctgcacttctggcagttgggtgagtcgcactactggggccataacgccatcatccgtgtgaaaccctttatcgagcactgcgcgctggcaccgttgcctggcgaaggttcgtttgccggttccatcctgtcgcatgacttcgttgaagcggccttgatgcgccgtgccggttggggcgtctggatcgcttatgatttgccgggctcctatgaggagcttccgccaaacctgctggacgagcttaaacgtgaccgccgctggtgtcatggtaacctgatgaacttccgcctgttcctggtgaaaggaatgcatccggttcaccgtgccgtcttcctgacgggcgtgatgtcctatctgtcagcaccgttgtggtttctgttcctggcactgtccaccgcgcttcaggtggtacatacgctgatggagccgacctacttcctgcagccaagacagctgttcccggtgtggccgcagtggcgtcctgaactggcgatagccctgttctcaaccacgctggtactgttgttcctgccgaaactgctgagcgtcgtgctgatctggtgcaaaggggcgaaaccttacggtggtgcactgcgtctgttcgtgtctctgctgctggaaatgctgttctcggtactgctggcgccggtacgtatgctgttccacaccgtctttgtggtcagcgcgttcctgggctgggaagtggtgtggaactcgccacagcgtgacgatgatgcgacgccatggagcgaagcctttaagcgccacggttcacaaatggcattaggtatcgtctgggccgccggcatgggctggctggatctcaacttcctgtggtggctggcacctatcgtgttctcgcttattctgtcaccttttgtatcggtgatgtcgagccgctcaggccttggcattaagagtaagaacgcgaagctgttcctgataccggaggagtacgatccgccgaaggagctgttagacacagaccgctatgtggagctgaaccgtcaacgtgcgctgaaaaatggctttatgcatgcgctgttccatccggcgtttaacgccctggcgacggcactggccacctcacgtcataagcagagtcagttgctggattatgcgcgcgatcgccgggttgatcaggcattgagtgatgcaccggaaaaactgagtcgggagcagcgtctgcagctgatcagcgatccggtggtgctggctcgtgtgcatactcgcttgtgggaaaacggtgagaagtatcatcagtgggtagagagttatcaaaaactccctctcaaccccgatgcgctaccgcatcaggcgtaatacttaaaaagcggcagagatgccgctttttttatgcctgtcgtcaggttacagacagcaacattattttgcacttttaccgaaatgggatggcaacccagcctcactcgtgattaaaatagcggctgtttaatctgggtcacaactgtgaataaattcgctaaattaaccgcgttatccctggctgttgtcaccctgagcggctgcggcagtattatcagccgtaccgtgcccggacagggacacggtaatcagttttattctggcgtaaagtgggatatccgggatggcgcatggcgggtgatcacgattctcgacctgccgctgtcgctggtggtcgatactttactgataccggtggatgccagccacggaccttatgagtaactgcggtcagagtcgctgttgtcgtcttcccattcctgtgcagcggctttaccttcctcgctgtccagcgggggctcaagctggaactcaccgtcatcccattcatgcagtgtattctccgctaaccactcctgacgcagttcaatttcatcgaaatcgccgtcgaaaatagcctgagcggcttcaccactgcgcaccggtaaacactcgccagaatccccttcatcttcaaaaaactctgcctgccacatgatgtcgccatcctgcatcacatatttttgcaggccaaactggttgattgaggcatcgtcttgctcaatatccggatgactgacgagaaattcttcacgtgcagcctcaatcgcttcttccagtgtagtgaacatactcatgcttctctccttgcctgattaacgtgatttcagtgaagaatagaccaaaatttcaggagggaaagtcaggacgctgcgcaggtcagaaattcgggccataaactgcaccataagaggcgtttactggctgaataacggctctgtatgcaagcctgctgggttgagtaccagatgggaacgacgggctaaagcaggtcgataccaaaccttttcaggcataacgcccacagcacgaacaggacgagggtgatcaggcaactgagtcccagcgtgagccagaagccggtgcgttggtacagaaaaggaaacaggataaacatcggcagggtcggaaccacataccaaaacgtataccaggcatgagcggcaattttcgcctgggtctgtccttcaattttcatccagatcagcacaaggatagtgacaagcggcagcgccgccagcagtccacccaggcgatcgctgcgcctggccgcttcagaaataatcaccaccatcagggcggtgatcgcatatttcgagataagccagagcatgaatttttccgtaatgaatcagttaagcggcagcgctcgcggtgttatcagcgtggtttccggtggaacaccatgcttaaggatgctaacacgatctctactgctgaatcagagcgtacacaacccttggggctgatgtcactcttatgtcactgtcgtttatcatcgtcatcgtcatcggctgcgacgccgcagtggactcaatagcgggagggttccccctctggacgggttttaaaacgacggtgtagccacatgtactgctcaggtgccagtagcacaccgtcttccaccaccttattcatgcgccgtgcggtgtcttcatcgctggtcagcggaaagtcagcgctcacgtcaggcaaaataatcaactcgtagccgcgcccttcaggcagacgacgcggtacaaagggaataaccgccggtttaccggtacgaatgagcatatgcgtacccacggtggttgccgccttttcgacgccaaagaagggcacaaatacgctgctgcgcgggccataatcatgatcgggtgcgtaccagataatatcgccacgcttcaacgcccgaatcatgcctttaagatccttgcgatctaacatccctttgtttgatcgcatgcggcctcgcgtctgcagccagtcgatgagtttgttgtcgttgggccgataaacgccgatgccgggattgtggatgccaaacatccgtgcgccgatctccagcgttaaaaaatgcatgccaattaacaacacgccacgctgggtgtcatgcgcctgctggatgtgttccagaccagaaggtttgtgccatttgtgaatccgccagtcgggccagaaccaggccatgccggtttcaatcagtcccatgcccaccgattcaaagttatgcttgatcatggcttcgcgatcgacatcgggcatatccgggaagctgagttcaagattacggcgagcaatggcaacgcgtcgtttcataaatcgtctggcaaggcgaccaatgccgctacccagcgcatagagcagcggatagggcagcaataccaggatatacagtaaaacgacacccagccaggtaaaccaatagcggggatgaagaagcgcacgtgaaaattgaggcaattgggtcatcttaaatattattatcctgcgtcgtgcaccagcggtgctgtttttcgtcagttgcggttattgtgccattttttttcccactgctgaaatgttacaacatttcgcagattgttgccgggagtgaaaaaagagagatataagtactcgggccaccgaaaatgtacaggtttaactatcaatttttcttatacgcttcgcatttttatcaattcaggtatcatgtgcgcgctaaatttcttctattgataacaggaacgaacaccatgccagtgttacataaccttgtttccaataaagagctgaaggcgcgtatgttggctgaaaccgagccgcgcaccacagtctctttttacaagtatttcactattgccgatccaaaagcgtttcgtgacgaactgtacctcggtttaaccgcgttaaaggtgtttggccgtatttacgtcgcgcacgaaggtatcaatgcacagctcagcgttcccgccagccagtacgaggcgatgagagcttttctgtacggctttgatccggcgttgaataacctgcgaatgaatattgcgctcgacgacgatggcaaatcattctgggtactgcggttgaaagtgcgtgaccgcattgttgccgatggcatcgatgacgagacctttgatgccagcgatgttggcaactatttgaaggcggcagacgtgaacgccatgctcgacgatcctgatgcggtcttcgtcgatatgcgaaatcactacgagtatgaagtggggcgttttgacaatgcgcttgaggtgcccgccgatacgttccgcgagcaactgcccatggctgttgacatgctcaaggacaagaaagataaaaaaatcgtgatgtattgcacgggcggaattcgctgtgaaaaagccagcgcctggatgcggcataacggttttgaggatgtctaccatgtcgagggcggcattattgaatatgcccgccgtgcacgtgaacaaaatttaccggtacgcttcaaaggtaaaaactttgtttttgatgaacgtatgggtgagcgcatttcagatgatgtgttatctaactgccatcagtgcggtacgccttgtgacacccacgtaaactgcgtcaatgacggttgccacctgttgttcatccagtgtgaaagttgtgcggaaaagtacgagcactgctgtagcccgctgtgccaggaggaagcgcgcctgtcacctgaagaacaacgtgcccgccgcgccggacgtgagaacgggaataaaatcttcaataagtcgcgtggtttgttgaatatgactattccagcgccaacccgcaaatagtcgccgccgcctgaagcctggcttcaggcggcttgttattacttacgcacgccttccactgagatgattaactcaaccttctgagaagcagggcccaaatcctgggtaatgttaaagtctttcagcgctatctcgccttcggcttcaaagccggcacgatagccgccccatgggtccttaccttcgcccatcattttggcttccagcgtcaccggttttgtcacgccgttcagcgttaaatcacccgttacggccagcttgtcgccctcttttttcactgccgtggacttaaatgtcgccgtcggatgttttgcgacattcaggaattccgggccacgaatgtgtttgtcacgctcggcatggttggtgtccacgctgttggtgttaatggtgacatccactttatccgccgaggggttattggcatcaaagctgaatgagccatcaaagtctttaaaggtgccgtacagccagctgtagcctaaatgctgaatacggaactgaacaaaggcgtgctggccttctttatcaattttgtaatccgccgcgttggcggtcagtgaacccagcagtaaaccggcgcttgtgatggccagaagcgttttcttaaacatattacttttccttttcagaggttgatcggatgcgcagacccagcatccttttcagggtgatatcgcgatcgataaagtggtgttttaacgcggccaggccatgtaagcccgaaaggatcacaatgctccatgccagccataaatgaatatctcccgctaaatctgcctgttcgcccgcgccggtcagtagagcaggcagggaaaaccacccgaatacggaaatgggtttgccgtcggcggtagagattaaataaccgctgaacaaaatggcgataagcaggctgtaaagtaaccaatgcgcgacgaccgcgctgatacgcacggcggtagagtagctgctcaggggtttgggcggcggggaaatcacgcgccacaggagacgaataatcagggccagcatcagcatgacaccaatgcttttatggatctctggcgcattgtgataccaggtatcgtaatagctcagaccgaccatccataaacccagtgcgaacatggcataaatgaccaatgccattgaccagtgtaagaaaacagagagcaatccataatggctggatgaattatttagcgacattttgcagcggcatcttaagaataagtggaaataagaatctacagaatgaaacacaaaagcaataatgcttacttttctataaatatcttgtgtactgatgaaatcgactcgcgaagtgaatcgggtaagcacaatattattgaatgagaaaattccagaatggatgaaaaaggcaaaaaggggacaaaacaggccggtaacggagagataacaagggaataaaacgcaaaaaaaccgctgactgtaaatttatgtcagcgcggcgccaggttaatcccgttcgccgcaccgtttttaatgaaaacgtgacagcctgaacggcgaaagatcaaattcaaaaggctggttctgagcaaactgactggcgagctcacctaacacgctggcaaatttaaatccgtggccgcttaagccggttatcaccagacgattgggttcgcccggcaaggtatcgataataaaatcttcatcgggactgaaatcatagctacaggcttcgccgtgcagacatacgcccacgccgggcaagaactggcgtaaaaagcgaaatgtttcactgccatcggcggcaaggctgccgaaaggtttgcgatcttccggttgggtcatcagctgaccaccgtcatggcggcctaccttcagggcgttgttatcggcggggaagccgtaatactggctgccatcggccatttcacaggtgaaccccggaaacgcattgttttcactgtagcgcccatccgcctgataccaggcaaagactttacgtgttggtgataccggcaggtcaggtatcagtttgctcacccatgtgcctgcgctcaccagcatcttgcgaccgcgataaatgccgtcaagagtggtgacctgctgtaaatcgccttcgcggctgatttgcgtcaccgggcagttaaacagctgcgcgcagccctgtttttcggccagctgaatccagcttcgtacggcctgttcgctttttaaaaagccggactgaggttcaaagacacccagataaccatcgggaacggtaaactgtggccagcgttttcggacttcctcggcctgtaatacctcgacagcaagctgccaggtttttgcgctattgatgacgttttggataaattcggaatgcgcgggcgcgatatttaagacgccgcaacggtgcatgatgcgttcggcagcctgctgttccagcgcatcccataatgcttgtgcccgcaaaaccaaagggacatagcgttcgccttctccgtaagcatgacggatgaggcggctttcgccgtggtgagcgccttgagtatggggcggatgtgcgctgtcaatcatcagcacggagaggcccgcttgtgtggcgtaatagcctgcggctgcgccaacggaaccgctaccgaccacaataagatcgtaaatcatgaaaatggaactcctgaaagggttacataatcaacagcataccagaaagcccaataaaaaaggcaccctggagggtgccttgctgatgcagcagtattaatgcttctttagtagtcgttctatctgctcggcagattcaatcttagcgatacccgcttcaagaatggagatgaactgctttgctacatcagtcgtcagccagtaggtagggccaacgtctgcgtcttcttcagtttgatcttgcgacgaaagggagtgcagacggatcatcatcgcatcatagctgtcaacagtactaatatcccagcccaccagtggatgggtctgaattacatctttgcgactgtccattataacctccttattactcgttaaacgaagtgcatgatgaggttcaatgcggctttttaatttccactgcgaaacaattataacagcaaaatagcgatttactgattaaacgtatcacggaacgcctgaaagcagaatatttgtttctaaaacggtaaggctgagaagatataatacctgaatgctggggcagtaatcgtcctaattgaacaataaaaatggcttattatccctcgttgacaccacgtcagataagcgaggtttcagcgcctgtcgtgccgctgcgcttttgtaacgtctctgccaggcgggcaaactgctgctgcagctgctcatcatggttttgattttgcgcttcaagagaaagattatgcaccagtaactgactggcccggtcatcaagacagaaaatcaggctggagaatgcattttccagcaccgttaaacgacgctgctgttcaccgataagcgttaacagctcgccaaaggtcatcgcttcttctggtttgtctgtagtcatgggatgcaactccttttatgcatgatcagcgccagcatagggcattgatcattcggagtccagatggggcgagcggttagtcagactttaaatgaagataaaaaaaccgggcggcgaaacccggcaaaaaacagcacagtagcggttaatcggtagtaaaccagtcgtcagcgctttcccatgtttgttgcaggatttcgctgatttgatcacgcgtatctttatcaccacccagaacgcttaactggttagccgtggcgtaacgcaccttgacgtggttcgtgaattgcggaaagtgttcatcaatgcggcgcgacagctcctggctcagggcttccatcgcgccagcgggaagaggttgggtcttggcaacggtaatttcaacacgcataaaagcctccgtataagatactgtatataactacagtattattaatcgggaggcaagtgaaattattttacgcgccagttcagcgtttcaccggcaaggaaaggcaccagctgatgtgaacccatctcaatggtttctgccactgtccacggctcacgcaccagcgtgatctggtcctgattaagcggcaggccatagaagcgtggaccattctcagaacagaacgcttcaaaatgctgcagggcatcgagctcttcaaataccgtcgcataagcgggcagggaggttggcgcattaaagacgcctgcacagccgcaactgctctctttcagatgacttaagtgcggtgccgtgtcggtccccaggaagacgcgtggatgaccgctggctaccaccttacgcagagcctgctgatgtgtattgcgcttcaggatcggcaggcagtaaagatgaggacgaatcccgccgaccagcatatggttacgattgaacatcaggtgttgaggggtgatggtggcggccagattttcattggcgctttccacatattccgccgcgtctttagtggtaatgtgctccatcacgactttcagcgcaggaaattgctgacgcagcggctccatcaccgtttcaataaagcgggcttcgcgatcgaagatatcaatatgcgcgtcggtgacttcaccgtgcaccaacagcggcatgcccagcgtttgcatccgctccagcaccgaggcaattgactgaatattggtgacgccatgactggaattggtggtcgcatgagcaggatagagcttggctgccgtgaacaacccggaacggaagccgcgtgtcagttcttcaggatctaacgagtcagtgagatagcaggtcatcagcggcgtaaaagcatgaccatcaggcaacgcggccagaatgcgatcgcgataagcttcgcccgctgcgacgcttatcaccggcggaaccagattaggcatgacgatggcacgaccattgaccgcgctggtataaggcagcacggttttaagcatatcgtcatcacgaagatggatatgccagtcatctgggcggcggatagtaagttgctgaggttgtgcggtcattaatacggctccggcatgaaggataaacgaatggcgtgtttgggccgggttataagcataaggactcaggcaaccgtttgcacctgtttttgcatctcaaaaaaaatccgcgccgaaaagcgcggagttgaagcgggatcaagacatcggtaaagcattaatcggtgaacggaatcaccagttcgccaggtttaacttccagacctttagcaaattttttcgccagcgattcagctttactgcggtcggcgctcagcacatacgcaggctgctggtcaaaatagctttttagcgactgattcaggtagggcgtcagcgttttcatgatagaagccatcttgtctggctgaacctgcgcatccacgatttccatatcacgcaggtagacggcaccttgctgttggtcgaacacaggttgggcgcgcatcttgagctgcatatcggcctgctgtgggccaaacagcgaggacacattgatcttggcattacccgataacgtgaccttacccggctcctcacgaccaatctgactggtgaggttgttcagcacgatatgggcattaaccagtcccgacacaccaatgtctttttcgaaattattgtgtttttgcagtgcctgattcacgtcctgttcgctgatggtgtattgggttaactgattacagccgctcagcaacaccgctaaaaacagggcaatcagcccgtaaaaagccttcttcatatttccctcatttaaatgaaaaagtagatcacgccatagcctgcctgaatgcaggcagtctgtcatcaggaatgggctgagatggcgttgccgtatgtgcctttcagcaagggcgctggagatcccacaggcataaatgcacagcctgatcttgtccggtaaatgtgccttctggcgcaagtcaggcggcttcttcaggggctgatgccgtcaaggcgaagcaaggaagggatgaaaaccacggcgacatcagacgcggcctttatcatgccggtcagcgtaaaaccattccgatcaccttcacggtcagcgtgtcggatgataaacaaacagcccggcggccattgtgtgtgtaacgttttaccgcagacctggcggcggttatagtgaatgttatcaaagactggcatttccttcccgccatggatttcaggagagatgatgtttggctatcgttctgccgcgctgagggtgcgactcactaccgagcggctggtggtaagactggttcacgaacgcgatgcgtggcgattagcggactactatgctgaaaatcgcgattttctcagaccctgggaaccggtacgcgatgacagccactgctatccgtctggctggcaggcccggctgggcctgattgcagagatgcacaaacagggttcagctttctactttgttttgatggacagcaacgaaacggaagtccgcggcgtggcgaactttagcaatgtcctgcgtggggcgtttcatgcctgctatctcggctattccctcggcgagaagtggcaggggcagggcatgatgtttgaggcactgcagtcggcgatcccgtacatgcagcggcaacaatatattcatcgcatcatggctaactatatgccgcacaaccagcgcagtggtgatctgctggcgcgcctgggctttgaaaaagagggatatgctaaaaattatttaatgattaacggccagtggcaggatcatgtcctcacggcgttaacctgcaaagaatggacacctaatcgtcgtgggtaagaagaggaatgctgaatgaagatggccttatcagcgcaggccctgcgcgttctgggttgcctgctggaaaagcaaatcactacaccggaacagtatccgctctcattaaacggcgtagtgaccgcctgtaatcagaaatcaaaccgcgaaccggttatggcgctgagcgaaagcgacgtgcaggctgaactcgatctactggtaaaaaaacacctggtcacgtctaacagcggcttcggtcaacgggtcgttaaatacgaacagcgtttctgtaattcagcttttggtcatttgcaactgagtcgtgcagaagtcgccgtgctcacattactgttcctgcgcggggcgcaaaccccgggcgaactgcgcacgcgaagtggtcgcctgcatgagtttgcagatgtcaccgaggttgaacagaccctggaagcgttggcatcacgcgaagacggtgcaatggtggtgcgcctggcccgcgaacccggcaaacgtgaaagccgttttatgcacctgtttgccggcgacgtggagcaagtaccctctcaggctgatgccgtcccggatgatgctgcgctactggaacgcgtgacgttgctggagcagtctgttgcagacttacaggcgcaactggcgcttttactggaaagagaacaatagatgacgattcgcattggtttagtcgggatgggtggtattgcacaaaaggcctggctgccggttctgtctcaggctcaatcctggcagttggtcggtgccttttcccctaatcaggcaaaagcgcaggtcgtctgtgaacgttatcgtattccgtgtttcgggtctttgaatgaccttgctgccgcctgtgatgccgtgtttgttcataccagtaccgccagccactacgaagtggtgcatgcgctgctgctggcaggaaaggatgtgtgtgtagataaaccgctggcggaaacccttaaccaggctgaaatgctggtgacgctggccgaaaagaaacagcgccggttgatggtggcctttaaccgccgttttgcgccccgctatcagcagctcaaggcggagatggacgccgttgcctcactgcgtattgagaaacatcgcggcgacagcgtagggccgcatgatctgcgcttcaccttactggatgattaccttcatgtcgtcgacaccgcgctgtggctggccggagggcgcacgcttccccgccagggacatatcgccaccaatgaacagggacaaatgctctatgctgagcaccatttcaatgccggccaggtgcaggtgaccaccagcatgcatcgtcgcgcaggaagccagcgtgaacgcatcagcgcggtaggggatggcaagtgcattgatattctggatatgcgcgactggcaggaggagcgcggggcgggcgtgatcatgacaccgcctgcgccatggcagagccatcttgcccaacgcggttttgtcggggcggcagaacattttattcaatgtgtcgaaaatcagacaaagccggagaccagcggcgagcaggccctgctggcgcaacgcgtggtcgaatcgatgtggcgcgatgccgaacgggaataatgccttgtaacactcatcgctggtcatttcgcacgatggcagtagactatcgcccgagctgtgacctaacccgtgctaagtcacgcatttagccgattcttttcaggatgccccatcaattatgaatttgttgaaatcgctggcagcggtcagttctatgactctgttttcccgcgtgctgggcttcgcccgtgatgccattgtagcgcgtgtattcggtgccggcatggccactgacgccttctttgtggcgtttaaactgcccaatttgctgcgacgtatttttgctgaaggcgcgttctcgcaggcttttgtccccattctggcggaatacaaaagtaagcagggagaagaagccacccggttgtttgtggcctacgtatcggggctgcttaccctggcactggccctggtgaccgtggcaggaatggttgccgcgccctgggttattctggtgaccgcgccggggtttgcggacaccgcagataaattcgccctcaccagcgcgctgttgcgcgtaacctttccgtatattctgctgatctccctggcgtccctggccggggcgatactgaacacctggaaccgtttctccgttcccgcatttgcgccaaccttgctgaatgtcagcatgattggttttgccctttttgccgcaccgcactttcatccgccggttatggcactggcgtgggccgtagtggtgggcggcgtgttacaactgggctaccagttaccccatctcaaaaaactggggatgctggtcctgccgcgtctcaacctgcgtgatgccggtgtatggcgcgttatgcgtcaaatggggcccgcgattctgggcgtgtcggtcagtcaaatctcgctcatcatcaacaccatttttgcttcttttttggtgtctggttccgtttcctggatgtattatgctgaccgcctgatggagtttccttccggcgtactgggtgttgcgctgggaaccattttgttgccgtcactggcgaaaagtttctccagtggcaatcatgatgaatattcgcgcttaatggactggggcctgcgcttatgctttttgctggcgttacccagtgcggtggcgttaggcatgttgtccgggcctctgactatcgcgttgttccagtatggcaagtttaccgcttttgatgcggcgatgacccagcgcgccctgatcgcctattccgtcggcctgatgggcctgattgtggtgaaagtactggcaccgggattctattcacgtcaggacattaaaactccggtcaagattgctattgtaacgctgattgtgactcagcttatgaacctggcctttatcggccctcttaagcatgccgggctggcgctctcaattggtttgggtgcctgtctgaatgccgcgctgctttactggcaactgcgtaaaaagaagatcttccagccgcaaccgggatgggtaggttttttactgcgtttattggtggccgtcgtgataatggctgccgcgctgtttgcgatgctctactggatgcctgtctgggagcagggcaacatgctgtggcgtttgctgcggctggcgttggtctgtgccgttggcggtggcgcttacttcctggcgcttgggctgatgggctttcgcctgcgcgattatgcgcgacgcacgaccgtctgaatgtaaaaatgccttgagcgtggcgtgatgtgttaaccctttatgcaagccgcaacggatcgcgttgcggctttttactgcccaggcgcagagcagggtgaggtacggcgttccctcggcctcactcaatgacagccatgatgcaacgctcctggttgcgctataaagcgcaggtgataccggctcacgttatggcaagggttgatgaataaagcgttgtgatgaaggtaaaacctgtgatgtagcgagaaaaaagcgtttcactgagatttgtcatcaataattcacggtttattcgttgatctttcgtatctggaaaagcgggatcgtgaaaatgctaatgttgtaataaattgattcaaaagtagatttttgcataaaaccctttcctgtcctgccgatgaatacagtcagtcaatcatcaacaggagagaagggaaatgcacaccaacgccactgaaaacgaaaagctaagtctctggcacaacctcaagcttattccattgttcagtctgatcttcggcagcatcttatttctgttcgtattaagcagcagtatttccgcctggtttctgagccagggcaggcattcgcttgacgtttcgactgatgaaattgaggtccggcaggggctgcttgacagttcaacgcacatgcgttcagcaaggctgaatatcattcaggcgggtgctgccacgcgcattgcggacaccgacaaatataacgcgtttttactcgccaccgatgccagcgttaagaaggccgagaaaggactcaacatttatcttagccgcgccgttaagacgcaagccgggatcgatcttgatgcgcagcttcagtcccgatttaacgattatcttcataagggactgctgccgatgatcgaggcggccaaacagggcagttttgaagagatcattgcagatgaaaccgaggccgacaccctcgacagggcctataaagatgtgctgatgaaagcgattcagatgcggaatcagcgctctcaggatataaaacagcaggccgtagagcaggttaagacaggttatatcaccatgttagcggcttttgtgtcgtcagttttggttgtgctactcgcttttgtgttactcaaaagggtggtgattaccccgttacggcagtctctgttccgtattgacctgatcgcccatggcgacctgaccgccaggccttccgcctgtggacgcaacgagccgggccggctgttgtccagtcttcaactgatgcagtcctccttgtcgaatacggtcggctcggtgcgcactggcgcaatcgcgattctccagagtgcgggagaaatttcttccggcaatagcgatctttcgtcccggacagaacagcaagccgcatcactggaacagacggcggcgagcatggagcaactgactgcgacggtgaagcaaaacgcagacaatgctcatcatgcgtgtcagatggcatctgacgcgtcgggtaaagtccagacgggcggcgacattgtgaaccgcgttgtaaaaacgatggacgacatttccggcagctcgaaaaagattgcagaaatcaccagtgttattaacagcattgctttccagaccaatattctcgcgctgaatgcggcggtagaagccgcgcgggcaggggaacagggccgtggttttgccgttgttgccagtgaagtgcgcaacctggcgcagcgcagcgcgcaggcggcaaaagaaatcgaaacactgatttcggcttctgtcgggctgattaacggcggcactgcgcttgtcagcgacgcgggcagtactatgatggcaacagttgagtcctttcgccgggtgaatgacattatttctgaaatcgcggcggcctccgatgaacaaagcaagggcattcagcaggttagtcaggctgttaccgaaatggatgctgtgacacagcagaatgcgtcgttggttgaacaggcctcggcggcggcggcttcgctcgaagatcaggccgataaactgacccaggccgtttcagttttcaaaatcgaaaaccactctgtaacccattcccttccccctttctctgcggtagccaaatccgttgacgcagtattgactgtgcctgacgtcggacatgaaaactgggaggccttttaagcaggagcaagagtgactgacggaatgcgtgtcttctcgttgggtgagatgcacgtcaggcttaagcggctattatctccagcgcgaaggacatggcgggtgaagccgccatgatcagacggaattgcctgtgtttattgccacgtctcaggcaagcctgatatcagtctgcaatttcataaatggcgaggcgcccgcgccgaaagaatcgatacggcagcgcgcaggcgcgttcagacccgggcgttgggatataaaaaaaaccgtcatccctgtgagatgacggttttttcaagacggatgacttaaggtttgtcatcacccagcagagacaacaggttgtctctggggagtgacagcaacaccggtcagcctttacggctcagcgttgcctgcccttgtcctttcccgtccgggccataaaacgcctgcgtctggtgaggtttcagaacgtctaaagcgtcatgggtaaaggtaatttgatgctgcaacaaaataccgttgtgagtatttgcattgtgtaaccgacgcgtgtgctgctggataccttcccagcggcgcgccatgtcactctgaccacgataaggggcagatgtacccaggcttttctcgttactacgacgcatctcgtctaaataattcaacgtactcagtagcgcacttttatcttctgtaatgcgctgcaagttgttgctgttgatcattccagacgacagctgttgttgctcttcatccagcacggtggccagagacaccagcacttcctgcatcttatctaacgtggtcagcaaattactcatggggattatttaccctctaaatacgccttagtgtcggcaattagcgcatcggcgattttgccagtatccatcttcaactcgccattacgaatggcggttttcaattgttctacgcgctggacattaatgtcctggctgctgggctgcataagctgtgcttgtgcactgctcaggttaacctgggcggctgcaggcgtggttgcagttgtactgctgctctgacgcactcgggcagtttgttgctcgctgctgtcacgtgtttgcacggtgcttgcgggcttagacggttgtgttctgtcgatgctcatattcgggctcctgtgaggtcaggggagtctgccacctgaatcataatagcgtaatcgcttagctgattcttctatcggcagataaacaggcttctttaatgttttatagtgttataagaattttcccatcatcgctcacacgaccactcacaacctgaccatttcccatacgcacccgaacccactgcgatatcgtgccattgttcaacgctttgccctcaccgctagcgtcaaacccgtctccgctggccacgaccatcacatcctggcctgctttaacgcgccatggctggcgcaacatagactgacttacaggttgccccggttggatatcacgcaagaccaccgcatccgctactgactcatcgttgagcaacgtgcgcggaggcaacgtatccagacgtccgttttcaatgcggaaatcatctttgctaacggtattgccacggggaatggcgtttttagcgaccagatacgccccagtgacctgtacctgcacctgaatataacggcgattctcaccgcagttagccgccacactcatgttgccccatgcccggctgttgcccggcagggtaaattgtggtgcgtcacacgctggccactgcgtctgcggcgtgcggataaccacattcatgcctgccgcgtgttggggatcacgcgccttaaaaaactggttcagttgggcactgaaatcgcctgccataacgggtaaggcaaacagggccagcaggccggctaacagggctggatatccacgcatgtgcttttcctcactgatgatgtcaacgagtgtacgcgcttaaaaaaaaactcaagagcaaaaatagcgacgatttgaggcgttattcagacgatgactcttgctttttcccgattaagctgccaactcgaaattctcatttgcggaggaagcatgctcgacaaactcgatgcggcgctacatttcggtaccgaagcccttaacctgcgagctcaacgtcaggagattctggcatctaacattgccaacgccgacaccccgggctatcaggccagggatatcgactttgccagcgagctgaatcgggcaatggcgaatggacgtgctgaaggcagtagcctggcgctcaaagtcacttcgtcgcgtcacattgaagcgcagacgaactcggcaccgtcaatgaatatgctgtatcgcattccggatcagccatctgccgacggtaacaccgtggatatggaccgcgaacgtacgcagttcgcggataacagcctgaaatatcaaaccgacctcacgcttatcagtagccaaatcaaaggcatgatgagcgtgttacaagggcaataattatggccttgcttaatatttttgacattgccggctcagcaatgaccgcgcaatcacagcgattaaacgtcagcgccagtaacctggctaacgccgacagcgtgaccggcccggacggacagccgtatgtggcaaaacaggtcgtttttcagaccgatgctgctcccggtgctgcgacaggtggtgtgaaagtggcgcaggtcgtggacgatcctacgccggcaaaactggtctatgacccaggtaacccaatggcagacaacaaaggttacgtgaaaatgcctaacgtggatgtggtagccgaaacggtgaacaccatgtcggcgtcacgcagctaccaggctaacgtcgaggtactgaacaccgtgaagtcgatgatgatgaaaacgctgaccctgggtcagtaacggagaaaaataatggctatctcggtaggcgttaatgaaaagctggaccccacggtactgagttcgtccagcaccggcacggggaacagttctcaggacctgcaaaaccagttcctgaccatgctggtcacacagttacaaaaccaggacccgacaaatccaatggataacagtcagctgacgacgcagctggcacagatcaacaccctgagcggtattgaaaaactgaataccacgctgggatcgatttccggccagatcagcaccagccagtctctgcagagctccacgctgattggacatggggtgatggtcaatggctcccagatcctggtaggcaaaggcaccacgacaccgtttggcgttgagctgactaacgcagcgaccaccgccacggcgacgatcagtgacgcacaaggcaatgtggtcagtacccaggacttgggttcactcactgcgggcgttcacaccttttcgtgggacggaaaattacctgatggcagcgttgcgccagatggtaaatacaaagttgcgattgctgccagtaacagcagcggtcaacaggtagcacagccacttaattatgcctacgtcaatggcgtaagcacggcgggtaataccgcaacactggatctcggcaccatgggctccgccacccttgacgacgtacgtcagattctctgattcacctgtagacaggagaggtttaaatgtcattttcacaagcggtcagcggtctcggcgctgcctcaagtaacctggatgttatcggtaacaacatcgctaactccgccacagcgggcttcaaatccagtaccatcgcgtttgccgacatgttcgccggctctaacgtaggtctgggtacaaaagttgccgccgttatccagaactttaacgatggttcaaccaccaccaccagccgtggactggatgttgcgctgagcggaaacggttttttccgtttgaccaactctgcgggcgcggtttcctattcacgtaacggccagttcacactcgatcagaaccgtaacctggtgaatacccagggtctgaatgtaaccggttatccggcatcaggcgtgccgccaacgattcaaagcggtgctaacccggttgcgattaaaatcccaaccacgcagatgtctgcgaacgcgaccaccacggctaaccaggtggcaaagctgaactcaacgtctgcaacgctggatgacaccaagttttcagccactgacccgacgacgtacagtgctaaaaacacaattaccatgtacgacacgcagggtaacgcccactcgcttgacatgtattttgttaagacggcaaacaacacctggaagattcatggcattgactcaaccgcgggttccgctgtgggtaactaccagatgtcctacgatgccaacggtcaaatgaccggtgtgtccagcctggatgcgacaggcgccgttgtcgcgggttcaaccacgccaagcacagccagtatcaccattcctggtgtcaatggcgcaaatggcacgaccgtggccttgaactttgtgggcagcctgcagcaaaacaccggtgcgaccacctttggtaacgccacgcaaaacggttatgccccaggcgacctgaccagctacgccattaataatgacggcaccatcaccggcagttattccaaccaacgtactcagttgctgggacaaatcgttctggcgagcttctctaacccggaaggcctgaaatctcagggtgacaacgtctggtcggaaacgaatgcgtctggacaggctgcagttggcctggcgaacaccggaacatttggttcactgaccgccggtgcgctggagtcctcgaacgttgatatgagtaaagagctggtcaacatgatcgtcgcgcaacgcaactaccaggcgaacgcgcagaccatcaaaacgcaggaccagatccttaacaccctggtcaacttacgttaattcgctaacgggattgctctatggatcacgcgatatataccgcgatgggcgcggccagtcagacactggatcagcaggcggttaccgccagcaacctcgccaacgcatcaacgcccggtttccgggcgcagttgaacgcgttgcgtgctgtaccggttactggctggtcgctgccaacgcgtacgctggtaacggcgtccacgccgggcgccgatatgagtcagggtgcaatggactacaccgaacgtccgttggatgtggcgatgcagcaggacggctggcttgcactacgaacggcagacggcagcgaagcctatacccgcaacggtaatatgcaaatccgttcggacggcacgctgacggtgcagggcaatcccgtcatgggcgacggtggtccgattgtgatcccacaaggcacagaggtcaccattgcggctgacggttctattaccggacttaacgcaggcgactcaccgaatgccacggtgcagttgggtcgtctgaagctggttcaggcaacaggtaaagagttacagcgcggggatgatggcatgttccgtccaaccgccgcgacgcaggctacacgcggcgcggcgctgcaggccgatcccaccatgcaggtgatgcctggcgttctggaaggcagtaacgttaaaccggtcgagaccatggtcgatatgatcgccaatgcccgacgttttgagatgcagatgaaggtcatttctaacgtcaacgaaaacgaacaaaaagccaatcagttgctgagcatcggcagctaaggcacgaggataaatacatgattcgttctttatggatcgcgaaaaccggtcttgatgcacagcagatgaacatggacgttatcgccaacaacctggcaaacgtcagtactaatggctttaagcgttcacgtgcggtatttgaagatctgatgtaccagacaatgcgtcaaccgggtacccagtcatcagaacaaaccacgctgccatcaggtttgcaaattggtaccggtgtgcgtccggtgacgactgagcgtttgcatacacagggcaacctgtcgcagaccaacaactcgaaagatattgccattaacgggcagggttttttccaaatccagatgccagatggtacgtctgcttacacccgtgatggttcgttccaggtggatcagaatggtcagttagtgaccaactccggtttcccggtacagccaggcattacgattccagccaacgccaccagcattactgtgtcgcgtgatggtgtcgtcagtgtcacgcagcaggggcaaactcaggccgcgcaggtcgggcagttaaccctgagcacctttatcaacaacgccggtctcgatagcgtaggtgaaaacctttacaaagaaacccaggcatccggtgcaccgactgacagcacgcctggccagaacggcgcaggtctgctgtatcagggttatgccgaaacctccaacgttaacgttgctgaagaactggtcaccatgatccagacgcagcgcgcctatgaaattaacagcaaagcgatcagcacctccgatcagatgctggcgaagttaactcagctgtaatgcgaacagggccggctcaggctggcctgaagaatagtcatttataaggtcgtgactccgtggcgatgcaacatattctcaagcctggacattggttagtagcaagcctgctactcactcttaacggttgtgcactggtaccgcgcacgccgttggtgcaaggggcgaccacggctcagccgttgccatctgcaccaccggtggtgaacggttcaatttttcagggcgtcgcgccgctcaactacggttatcagccgctgtttgaggatcgtcgcccacgtaatatcggcgatacgctgaccatcacgctgcaagaaaacgtcagcgccagcaaaagttcgtcctctaacgccagccgaaacggcagcggtagcctgggcattaccgccgtacctacgggccttgccggtctggcaggcgctgcaggtgaaaaagccaactttgcggcaggtggcaaaaatgatttcgcaggtaaaggcggcgcgtctgccaacaacacctttaccggcaccatcaccgtgaccgtggatcaggttctgtcgaacggcaacctgcacgtggtcggtgaaaaacagattgccattaatcagggcaccgagtttatccgcttctcgggcgtggttaacccacgcaccattagtgccagtaacgcggtgttgtcaacggccgtcgccgatgcacgtattgagtacatcggaaatggttatatcaatgaagcgcaaaccatgggttggctgcagcgtttcttcctgaacatctcgccgttctaagaggtttcaatgaaaaagttagcattatggcgtgtcggtctgtggttactgttaggcgtaagtctgatggctcacgccgatctgatccgcgatttaaccaccgtacaaggtgtgcgcgacaaccaactgctgggctatgggctggtggtgggtctggatggtacgggtgaccagaccactcagacaccctttacgacgcagactgtcagcaacatgttgtcccagttgggcatcaccgtgccgcccggcactaacatgcagctcaaaaacgtagcggctgtaatggtcacggctaaattgccctcgtttgcccgtcagggacagacgctggatgtggttgtctcatccatgggtaatgccaaaagcctgcgcggcgggacgttattaatgacgccgatgaaaggcgtggataaccaggtttatgccctggctcaggggaatatcctggtcggtggtgcgggtgcttctgccgggggaagtagtgttcaggttaaccaactgaacggcggacgtattaccgaaggcgcgacggttgagcgtgaattgcagagcaactttggctcgcaaaacaccattaacctgcagctcaacaccgccgatttctctatggcgcaacgtattgcggatgcgatcaatggacgtggcggctacggctctgcgcagccgctggatgcccgcaccgttcaggtacgcgtatcacctaacaacggtgcacaggttcgcttgctggccgagattcagaacatcgatgtgtctgtcccggttgaagatgccaaagtcattatcaactcgcgtaccggctctgtcgtgatgaatcgtgaagtgaaactgaacacctgtgcagtggcgcagggcaacttgtctgtgacggttaatcagcagcagaacgtcagccagcctgatacaccgctggcgggtggacaaaccgtggcaaccaccaatacacagatcgacctgcgtcagagcggcggtgccctgcaacgggtgaattccagcgccaacctgaacagcgtggtacgtgcactgaatgccctgggcgcatcgcctatcgagctgatgtctattttgcagtcaatgcagagcgcgggttgcctgcgcgctaaactggaaattatctgatgaatgatgcgcaatcgctgatgaatgcggcttttgacagccgctcactgaacgaccttaaacgccaggtcaccgccgatccgaaaggaaaagcgctgcaggtggcacagcaggtcgaagggatgtttgttcagatgatgctaaagagtatgcgcgatgcgttaccgcaggacggcgtactcagcaatgaacagaccaaactttttacttcaatgtacgatcagcagattgcgcaagacatcggaaaacgtggcctgggcctggcggatatcatcgtgaaacagatggaacccgccaaagccccggatgagaccgccggcaccgttccgatgaaactggataacagtttcattatgagcaatatcggggcaacgccactggagcagatggtgcgcaaagccatgccgcgtctgccgccagcctcgccaacgggactgcccggcgacagccgcgattttattgcccaactgacgcagcctgctcaggctgccagccagcagagcgggattccgcaccacctgattctggcgcaggctgcgctggagtccggctgggggcaacgtcaaatcctgacccgtgacggtaagccgagttacaacgtcttcggcattaaagccagcgccaactggaagggtgaaacaaccgatatcatgaccacggaatacgagcatggcgaagcaaaaaaagtgcgcgccagcttccgcgtttacggatcgtatttcgaagcgttgaatgactacgtcaaactgatttcaaacaatccacgttatgcggccgtaacaaatgcgcagagcgcggagcagggcgcacaggcattgcaggctgccggttatgcgaccgatccaaaatatgcacagaaactggttggaatgattcagcaattcaagagcatgggtgaaaaagtggttaaagcgtatagccaggatttaagcaccctgttctgattattcggcctcaagtttcacttaagcatgccgataataacagcaagagccaggcgcgccagcgtacgttggcgaccacactgatgacagcgacccgtccaacgggggaatgtaaggaaccgagatgtccagcataattaactccgcaatgagcgggctcagtgccgcacaggccgccttaagcacgaccagtaacaatatcagtaattacactgtcgcgggctactcgcgtcagaccaccattctggccgaagcaaacagtaccctgcaggggaaaagctattacggcaatggtgttaacgtcaccggtgttcagcgtgaatatgacggttttatcgccgctcagctgcgcggatcgtcggccaattataatgcggcgaatacccagtattcgcaggtatctaatattgatgatctgatgtcgacgtcgaccactaacctgtcaacggcgattcagggcttcttcagcaacatgcaaaacgtggtcagtaacgccaacgatccggcggcgcgccagtcgatgctcagcaactcgcaggggctggttaaccagttccagactcaggcgcagtacctgaccaacatgcaaaacagcgtgaacaccaatattgcctctaacgtcgatcagattaataccttcaccacgcagatctcgaatcttaaccagcaaattgccaaactaagcacggctaacggtgcaacaccgaatgatttgcttgatcagcgcgatcagttagtgaacggcctgaataatatcgttggtgtgacagtgtcacagcaagacggcagctatacggtttcgatggcgaacggcacgtcactggtgaatggttttcagtccaccaagctggtggccatgccgtccagcagtgacctgacgcgcaccacagtaggttatgtcgaccctcaggctggcaacgtggagattccggaatcgtctctgaccacggggtcgctgggcggtatgctgagcttccgttcgcaggatctggacctggcacaaaaccaactgggccagttagcggctgcctttacgaccagttttaacaccgtgcacaagcaaggcttcgacagcaacggtaatcagggcgtcgacttctttaatatcggcagtcctacggtgcaggggaacagcaaaaatacctcttctgccaccctgacggcagcgtggactgacaccagtgccctgcaggcatcaaactataccgtcagctatgacgggacaaactggtcagcgacacgtttgtcagataacaccaaaaccacgctcacacccactacctcgggcggcgctacgacgcttaacctggatgggatgagcctgacggtcaacggcacgccaaacgccaaagacagtttcctggtgaaaccggttcagaacgtggttaacggcatgtcggttgctattaccagcggatcacaaatcgccgcggcggccgcgaccggcggtgagagtgataaccgcaatgcgcaaaagctgctggcattgcaggatgccaaagtcgttaacggcaacgcgacgatttcccaggcttacggcgcgatggtgagtaccgtcggcaacaaaacccaggcactcaaaaccgccagcacgacgcagcaaaacgtggtgacgcagctaaccaaccgccagcaatctgtttctggcgtgaacctggatgaagagtacgcgaacctgacgaaataccaacaatattacatggcgaatgcgcaggttttaaaaacggccagcaccgtttttgacgccctgcttagcatcaactaaaagcagaggacatcatgcgactcagtacaaatatgatttttgaccagcaggttcgcggcgttagcgatgcgcagtcctcttggttaaatgcgggaaaacagctttccaccggactcagagtgtctaatccttcagacgacccgattgccgcgtctcgtgcggtcgtgctgtcgcaaacgcaggcgcaggcaagccagtattctgtcgcgcgtacctttgccgaccagggattatcgctggaagaaaacacccttaatggcgtcacgaacagcatcatgagcgcgcagtcgatgattgtggcctccgctaatggttccttaagcgacgacgaccgtgcttcttatgccacgcagctggaaggggttcgtgcgcagttactcaatcaggtaaacagcaaagatgccaacggacgttatatctttgcaggttacaaaacggatagcccaccgtttgtggatggtgcgggcggcgtcacttatcagggcggaaccgatgcgattacccagaaagtggacactgaccgtacgatgaccatcggtcacaccggcaacagcatcgtgatgtcgattaccagcaatgcggtgaaagagcctaacggcggtaccagtgaaacgaacgtgtttaacatgctggacagcgccatcagtgcgctgaaagtgccgcaaaacggcgcggacgatgcgacgaaagccacgttttctgcggcaatggataaaaccagccgtggcctgagcaactcgcttaacaacgtgctcagcgtccgttccgagatcggtacccagctgaaagagttagatacgttgaatgcacagggggacgatcgcaaggtaatttatgattcccagatgagcagcctggtggacgttgattacacccaggcgatctccagctacaccatgcaacagcaggcgctgcaggcttcttacaagacctttaccgatatgtctcagatgtcactgtttcagttaaattcataaaacgaaatttgggcgtactttaaccgggtgcgcttagtttttcccaccttcccgataagggatggtgggattttttttgcctggatattcgccctttcacggaggtcggtattgatgcgtccggtggcgtatcagtcagggctgaggctaaatcctctgcccggcataacgacacgctggtggtgggataagggggaaagctggctcgccgacgatgaagaggtaaggctgctagcaggggacaggcaatggacggctacgaaggctggcagaggggttgactgtctggcgacaaagcccggagtttccacatgcagtcgccagggcacaaaagtggctttctcttcgtaatacagcagacaacaggcaataaaaaacccggccggagccgggtttgtcgataccgttacctggccttacggcttggtagcaggtgcagtggcctgatgggtggcgctatggccgcccgccgatcctctgccatcaaactggaaagaaggacgctgccagtcactctgaggcgcaggctcgggttgccatgcaggtgcaggtgccttagtcatcggcgcagaggcaaaatgcttccagcgcgtttcgacattggcgttaaccgcctctacaggaacatcgcgtgcggcaaccggcgcatgaggttcgctaaccggagtgagggtttcctcagcggcgacaggcgcgtttaagacctcttccacctgggcttcggtcgctgcgctcacgtcggtgccggcatgttctgccgttgcagattgcgccgtttctactgcggcggatgctactgcggttggtgcgttaacctcaggttcttcggcaacgtcagcaggctgtgcctgttgcgcaatctcttcagcacgggcttcaacggccgctggaattaccgcgggttcatgattcaccggcgcatcaatcgcgtgggtatcatcagtattcaccacagtaaccggagtttcagcctgcggttcagcaatttgcaccggtgcagcctgggaagcaggggcttcatcagtcacgacaggcagtgcaatggctggtgccgtttcttcgcggtggtaatctggcgtcgttttcgctgtgtcctgaagggtttgctcttcattcgtttgcgcgaccggataacgaacccagactttgcccgaggccatttcaggagaagccgaggcggcttctaacggcatggcggactgcgtcgggtaacgctcatcacggtaacgacggcgacgctgaccactgacacgcagatgacgaggcgaacggcgtgaacggcgcggcatattggcattatcgcgaccgtcatgttcctccgtctcctcaacctgcgaggtttcaacaacaggctgaacctgacgagcttcaacaggttcagctgactcaatagccgccacctgaggctggtcagtgttttcgccaacgcggattttctgcgtcagttgacgtggtttgcggcgtggcattacctgcacgcgctcatcttcctgcgcatccacagcgaccggggctacaacctcaacggcttcttcaaccgtggtgctgacatcctgctgggcgcgtttctcttcctgacggcgacgctgacgttcagcacgctgttcgcggcgctgttgctgctgctcatcacgttgctgacgggcttcgtcgctcagtaccggacgatcgtcacgcgcttcattcggctgtgcctgacgcttgttgcggcgattgtcttcacgcggttcgcggctgtcgcgaggctcgcggttatcacgagcgtcacggttgtcacgagattcgcggttatcacgggattcacgctgctgcgtgctgtcgccattacgtggcgtacgctcgcgacgattgttgttgcggcggttgttacgacgatcgccacgctgattgccattttcttcttcgctggctttctgcggttcagaaacctcagcaacaggctcggcagcagctggagcaggttcgctagcaaacagttttttcaatccacctaacaaacggcttaccaggcccgcactggcaggtgctgccgaagcagcaggggcggtctcagtaaccgacgctggagcagcggtaaccacatccggagaggcttccgcaggtgccggcggcgcatcaggcatcacaaacgctgccagcgcaggttgctccggacggcgacgttcggcatgttcctcttctgatggcatcgccatctcagcttcatgcagcttcggcaggtggtagctcagcgtctgggtttcctcacctttacgcacgcgtaaaacggagtagtgcggcgtttccattctgtcgtcaggaacgatgaccgcacgcacgccgccctgacgtttctcgatagcattcactgcttcacgtttttcgttcagcagataagaggcaaccggaaccggcacaatggcatgcacttctttggtgttgtccttcagcgcttcttcttcaatcaggcgcagaatagacaatgacagggattcgttatcacgaatggtgccggtgccgctacagcgcggacagacgtgatggctggactcgcccagcgatgggctgagacgctggcgggacatttccagcaggccaaaacgtgaaatatggctgatttgaatacgagcgcgatcctgacgtacggcttcacgcagacggttttcaaccgcgcgctggtgacgaacgggcgtcatatcaataaagtcgataacgatcagaccgccgagatcgcgcagacgcaactgacgggcaatctcatcggcggcttcaagattggtattaaaggcggtttcctcaatatcaccgccgcgagtcgcacgtgcggagttgatatcgatggcagtcagcgcttcggtactgtcgataacgatcgacccgccggaaggcaagcggacttcgcgctggaaagcggattcaatttgcgattcgatttgataatggctgaacagcgggatctcaccggtgtagagcttaatcttgctggtaaagtccggacgacccagggcagcgatatgctgacgagctagctccaggactttcgggttatcgataagaatctcaccgatatcctgacgtaaataatcgcggaacgcgcgcacgattacgttgctttcctgatgaatcaggaaaggcgcagcgcggctgtcagcggcttttttgatggcttcccagtgcttcaggcggaaactgagatcccactgcagggattcggcagatttgccgacgccagcggtacgaacaatcagccccatgccatccgggagttccagtgccgacaaggcttctttcagctcggtacggtcatcaccttcaatccgacgtgaaatcccacccgcacgcgggttgtttggcatcaataccaggtagctaccggccagagagataaaggtagtgagggccgcgcctttgttgccgcgttcctctttatcgatctgaacaatcacttcctgaccttcacgcagcacgtctttaatattcggacgaccgtgagagttgtagtgagcagggaagtattcgcgggaaatttctttcagggggaggaaaccgtgacgttctgcaccgtaatcgacgaaggccgcttcaaggctgggttcgatacgggtaattttacctttgtagatgttggcttttttctgttcgtgtcctgggctttcgatatccagatcgtacagacgttgaccatcaaccagggcaacgcgcaactcctcctgctgagttgcgttaattaacattcttttcatcgtgacgtactcgttattctttcatgagtgattaaagctgcgggcatagttaccctggacgagtatcaaccgatggccccgtgacttagtgcaatgtcgtcaacctcacggttatcgaccgcgcgaggggcgcaaataacgtcggtggcctgtttttcataaggaacaacagcaccagatagtggaaatgcgagagataattcagtaaacccgagcactccatctcatgtccaggccgcaacccgcagcccgctaactgtctgatttcgcattacgtcttacgccattgctgcgtgtctgctcaatccgacaaaataactaatttcgctgttttcttctctgaatcttcagctaagaaacctaagcattattccactgctaaccttcatatagcaaggcgactttaactcactgatcaattttctttacattttaagaaccctgcgacagaaagtgcgccagtgctgctgtaaatcacagcaatcacattgcccgttctgaggggacgcagagagttaagcacagaaaaaggggtggcgctatcaggggacactatttagaatcgccgccatgaaaacagagaatcccggcgtacaatttgtcgccatcacggctgaaaatgccggacagcgtattgataactttttgcgcacccatttaaaaggtgtgccaaaaagcatgatttatcgcatcgtgcgtaaaggcgaggtgcgggtgaacaagaaacgcattaagccggagtacaagcttgaagagggcgatgaggtccgcatcccgccggtgcgcgtggccgaacgggatgacgaagccgtgtcgccgaagctggcaaaagtggcttcgctggcaaacgccatcctctttgaagatgaccacctgttggtattgaataagccctccggaacggcggtacacggcggcagtgggctaagctttggcgtgattgaagggctgcgcgcgttgcgtcccgaagcccgttttctggagctggtgcaccgtctggaccgggacacatccggtgttttactggtcgctaaaaaacggtctgccttgcgctcgctgcacgaacagctgcgcgagaagggcatgcagaaagattatctggcgctggtacagggcaactggccttcacatttaaaagtggttcaggctccgctgctgaaaaatattctacaaagcggtgagcgcatggtgcgggtgagcggagaaggcaaaccttcagaaacccgttttaaagtggaagagcgctttgacggtgccacgctggtcaaagccagcccggttaccgggcgcacccatcagattcgtgtgcataccttacatgccggtcatccgattgcgtttgatgaccgctatggcgatcgggcgtttgacagccaactggctcccacggggcttaaccgcttgttcctgcacgcggccgcgctgacctttactcatcccaacagcggtgaaacgctgcgcatggaagcgccgctggatgataagttacagcactgcctgacgaagctgcgccagcagaagagctgacgcacggggcatcagtcctctaatggattgatgcctgcttcgcgcaacatgtcggtcagcgcaatcagcggtaagcccaccagcgtattcggatcgcgtccctccaggcggtcaaacaaacaaatccccagtccttcgcttttaaaactgcccgcgcactgcagcggttgctccttctttatatacgcacgaatttcctgctgggttaaggtccggaaatgcacggtgaaaggttcgcagcagtgcattaagcgctggctggcagggtgatataacgccagcccggtataaaaggtaacgctgttaccgctggcggcgcgcaactgtgcttccgcgtttgcctcggtatggggtttaccggttatcacgtcatccagtacgcacacctggtcagagccaataatccagtggtcggggtagcttccggccagcgcctgcgctttggcgatggcgagtcgcgtcaccagtgcctctgcgcgttcattctctaacggcgtctcatctgtttggggagaggcgaccgtaaaaggcaagcccagccgggccaggagcgcctgacgaaagggggaggttgatgctaaaagaatcgatgctgtcattttttttcaatattgatagcgaattggtgacagtcattttaaactgtgcgccgcactggatgcgaatagtggttgaaagatgctgtttaacggcctttttctttgactctatgtgattacaaagttaatatgcgcgccctatgcaaaaggtaaaattacccctaacgctggacccagtccgcaccgctcagaaacgcctcgattatcaaggtgtttatacctctcaacaggttgagcgtgtcgctgagtcggtcgttagtgtggacagtgatgtagattgtgtcatgtcgtttgcggttgataaccagcgtctggcagtactgacgggtactgctgaagtacaagttacgctgcggtgtcaacgctgcaaccaggtttttccacatcatgtacacgtaagctattgcttcagtcctgtgtcgtctgacgagcaggccgaggcgttgccggaagcgtacgagccggttgatgtcaacgagtttggtgagatcgacctgctggcagttatcgaggatgaagttattctcgcgctgcctgtggttccggtgcacgattctgaacactgtgaagtgtccgaggcggacatggtgtttggtcagttgcctgcagaggcagaaaaaccaaacccatttgccgtattagccagtttaaagcgtaagtaataggagtaaggtccatggccgtacaacagaataaacccacccgttctaagcgtggtatgcgtcgttcgcacgatgctctgaccactgccactctgtcagtagataaagtttctggtgaaactcatctgcgtcaccacatcactgcggatggttactaccgcggtcgcaaggttatcgttaagtaagttctttgcttagcaaggcgataccttggcacgtttgaccctggctatcgatgccatgggcggggacttcggcccctgcgtgacggtgcctgcagcattgcaggcactggcctctcattcggaaattatccttcttcttgtcggagatcccgacattctcacgccattgcttgccaaagcggattcctccttactggagcgactgcaggttgtgcctgccgaatcagttattgcaagtgatgcgcgacccgcacaagccatccgtaacagccgcggcagttcaatgcgagtggcgttagagttggtcaaagaagggcgggcccaggcctgcgtcagcagcggcaacacgggcgcgctgatggggctggcgacactattacttaagccgctggacggcattaaacgtccggcgcttatgaccgttttaccccatcagcagaagggaaaaacggtcattttagatttaggtgccaatgtcgactctgacagtgcgatgctggtgcagtttgcggtgatgggctcagttatggcggaagaagtgctgggcattgcgaatccgcgtgtggcacttctcaatattggtcatgaagagcacaaagggcttgaaagcatccgcgatgcggcgttaagtctcaaggcattgccgcagattaactacattggttatctcgaaggtaacgatttactgactggcaaaacggatgtgctggtctgtgatggtttcgctggaaacatcacactgaagaccatggaaggcgtagtaagaatgtttctttccctgttcaagtcgtcaggggaaggtgaaaagcggtcgtggtggctgacgttgctggggcgctggattaaaaagcgtttggccaggcgcttcgggcatctcaaccccgaccagtacaatggcgcttgtctgttaggattacgcgggacagtgataaagagccatggcgcagcaaatcaacatgcttttgccgtggcgatcaatcaggccgagcagacggtgaggcggcaggttcctgaacgcattgccgcccgtctggacgctgtattagccaggagtgacaaagcctagatgtttaccaaaattatcggtacgggcagttatttgcccagccagatccgcaccaatgccgatctggaaaaaatggtggagacctcggacgagtggattgttacccgtaccggcattcgtgagcgccgtattgctgctccggatgagactgtcgcaagcatggggcatcaggctgcacagcgtgcactggaaatggcaggcgtcgacgccaatgatgtggggctgattattgtcgcaaccacgtcttccagtcatgccttcccaagctctgcctgcatgattcagcagatgctcgacatcaaagactgtgcggcatttgaccttgcagcggcctgtgctggctttacctatgcgttaagcgtggccgatcaatatattaaaaatggtgcggtaaagcatgcgttagtcatcggggctgatgtcctggcgcgtacgctcaatcctgacgatcgcggtacgatcatcctgtttggtgatggtgcgggtgccgtggtgctgggtcagagcaaagagcaggggatcatttcaacccacctgcacgcggacggccgctatgcccaattgctgacgctgccttatcaggatcgtgcgaatcaggatcaacccgcttatctgacgatggcaggcaacgaagtcttcaaagtggcggtaacagagctagcgcacattgttgatgagacgttgcaggcaaacaacattgcgcgtgaagagctggactggctggtgccgcatcaggctaacctgcgtattatcagcgccacggcgaaaaaactgggcatgaccatggaaaaagtggtggtcacactggatcgtcatggtaatacgtcagccgcgtctgtgccaagtgcgctggatgaggccgtgcgcgatggccgcatcaaacccggacaacttattttgctggaagcctttggtggtggattcacctggggttctgcgctggttcgcttttgattgacaggaactgaaaatgacgcaatttgcttttgttttcccaggtcagggctcacagaccgtgggcatgttaacggaactggctgctgcttatccggccgttgaagccacgttccgtgaagcttctgacgtcctcggttatgatctgtggcagttagtcagccagggacctgctgaagcgttaaataaaacctggcagacacagcctgcgctactggcggcttcggtagctatctaccgtgtctggcagcaacagggtggcaaacagccagccctgatggccggtcatagcctgggtgagtactcagcgctggtctgcgcaggcgtgctggattttgcggacgccatcaagctggttgaactgcgtggtaaactgatgcaggaagccgtgccagaaggcaccggcgctatgcaggcgatcatcggtcttgatgatgcagccattgcaaaagcctgtgaagagagtgcgcagggcgaagtcgtttcgccggtaaacttcaactcgccaggtcaggtggtgatcgccggtaacaaagatgcggttgaacgcgcgggtgcagcctgcaaagcggcaggtgcaaaacgtgcgctcccgttgccggtaagtgttccttcccactgcgcgctgatgaagccagcagccgataaactggcgctgacgctggaaaacatcacctttaatgcgccagtggtaccggttattaataacgtggatgtaaaagcagaaacggacgccgacgcgattcgtcatgcgttgattcgtcagctttacagcccggtacgctggacagaaagcgtcgaggccatggccgctcagggcgtcactcagctgtttgaaatgggaccaggtaaagtccttaccggtctgacaaaacgcattgtagacggcctgtcagcagcagcggtgaacgatactgcgtcattgactgcggcgcttgcacaggaataagaggaaaatcatgagctttgaaggtaaagtagcgctggtaactggcgcaagccgcggcatcggccgtgcgattgcagaaaccctggccgcacgcggtgcgaaagtggtcggtactgcaaccagccaaagtggtgccgatgctatcagtgattaccttggcgataaaggacaaggtctgctgttaaacgtgacggatgccgcttctgtaaacagtgttttagagaaaattcgcgcggaatttggcgaagtggacattttagtcaataatgcaggcattacgcgtgataatctactgatgcgtatgaaagacgatgagtggcaggatatccttgataccaacctcacatcggtattccgtctttctaaggcggtgatgcgtgccatgatgaaaaagcgcatgggtcgtatcatcaccatcggttctgttgttggaaccatgggcaatgcgggtcaggcaaactacgctgcagcaaaagcaggtttgattggctttagcaaatcactggcgcgggaaatcgcgtcacgtggcattaccgtcaacgtcgtggctccgggcttcatagagaccgacatgacgcgggcactgaacgaagatcaacgttccggtattctggcggaggtcccagcgggtcgcttaggcgaagcgcaggaaattgctaatgccgttgcattcttagcctctgacgaagcagcctacatcacgggtgagacgctgcacgtcaatggcggcatgtatatggtctgataattacgaaatcatttgcattatttgcggataaaaccgcacaatagcgtaaaatcgtggttcgaccagccgggattttgttgcatctttttcaacattttatacactacgaaaaccatcgcgaaagcgagttttgataggaaattaaatagtatgagcgatatcgaacaacgcgttaagaaaatcatcagtgagcagctgggtgtgaaagaggaagaagtgaccaactctgcatctttcgtagaagaccttggtgccgattctcttgataccgttgagctggtaatggctctggaagaagagtttgatactgaaattccagacgaagaagctgagaaaatcactaccgttcaggcagcgatcgactatatcaatagccataaaggctaatgaatatcttcaggcggtcaattgaccgcctgagttttatgtttgcccctcaatagtcatttttatccctccctggaggacgaacgtgtctaagcgtcgtgtagttgtgactggtcttggcatgttgtctcctgtcggcaataccgtagagtctacctggagtgctctccttgccggtcagagcggcattaacctgatcgaccattttgataccagcgcctatgcaacacgttttgcaggtctggtaagagatttcaattgcgatgactttatctctcgtaaagatcaacgcaagatggatgacttcattcagtacggcatcgtggcaggcattcaggccatgcaggacagcggtctggttgtgaccgatgaaaatgcaggccgggttggcgcagcaattggttcgggcatcggtggtttgggtctaatcgaagacaaccatacttctctggtgaacggcggcccgcgtaaaattagcccattctttgtgccttccacgatagtcaatatggtggcgggtcatctcaccatcatgtatggcttaaaaggccccagcatttccattgcgaccgcctgtacttctggcgtgcacaatatcggtcatgctgcacgtatcatcgcgtataacgatgctgacgtgatgctggcgggcggtgcggaaaaagccagtacgccacttggcgtaggtggattcggcgcggcgcgtgcgctgtcgacgcgcaacgaaaaccctcaggcggcaagccgtccctgggataaagaccgtgatggatttgtactgggtgacggggcgggcattatcgtactggaagagtacgagcatgctaagaaacgtggcgcaaaaatctacgcggaaatcgtgggctttgggatgagcagcgatgcttatcacatgacctcaccgccggaagacggttcaggtgcagccgctgcaatgatcaacgcgttgcgtgatgcgcagatgacgccagacaagattggttacgtcaatgcacacggtacttcaacgccagcgggtgacaaagcagaagcccaggccgtgaaatcggtttttggtgcagcagccaggacggtgatggtcagctcgaccaaatccatgaccggccatctgctgggtgcggcgggcgcggttgagtcgatttattcgattctggccctgcgcgatcaggcggttccaccgacgttgaacctggataaccctgacgaaggctgcgatcttgatttcgtaccgcataccgcacgtcaggtttcgggactggaatacgcactctgtaactccttcggcttcggcggcaccaacggctcgctgattttccgtaaaatctaaacatcgcgtttatgattgctgtaaaggcccgcaatgcgggccttttttctattcagtggcccagaaaaaacgataaaatcacggccatcgctgaacaacatgctgacaccggagtaagggcaatgtggataaacggcactgaacaaccccatctggcggccagcgatcgcgccgtacagtttggcgacggctgctttaccaccgccgccgtctgtcagggcagaatcgtcctgtttgacatgcatatgcagcggttgcagcaaagctgtgaacggttgtggctgagtggtgttgactggtctgagctggcgcaggagatgcaacaggcggcgagcggacatgacagggcagtgcttaaagtcatcctcagcgccggcagcggtgggcgcggctacagccgcacaggctgtagcggccccacgcgaatcgtctcggtatccgcctggccagcgcattatgcaaggttacagcaaaccggcgtcaaactggccgtcagcccggtacgtctggctcggcagccacagtttgccggtcttaagcacctgaaccggctggagcaggtgatgattcgtgcccatcttgagcagacagacgctgatgaggcgctggtgcttgacactgaaggttgggtggtggaatgctgtgcggctaatttattctggcgaagcggcggcgcactttttactccggcgctggatcaggcgggcgttgacggcattatgcggcggagtctgatagcggaaatgcgtgccgcaggccaaatttgtcaggtggtacaggcgggattagcgcagctactggcagctgatgaaatcgtcatatgcaatgcgctgatgcccgtattatccgttcgacaacttgatgcggtggaattcaaccagcgcaccttgtttaaccagctacaggcaagctgtagaaagataatggaagcataatgagccgaagcaaaaaaataatggtgagcgtgctggtcatcctgctcatcgcggcagccgtaagctactggcaggtgaaacaactcgctgccagccgcttaaccctttcccaggaacagatctatacgttgccggcagggaccggtcgcgtcgccttagaagcgcagctggaaagccagcacatcattcctcacagcatctggtttggtgcattgcttaaacttgagccagagctggccaaatttaaagccggaacctatcgccttgagccgtcgatgacggtacgcagcttgctggagctactggccagcggtaaagaggcacaattcccgctacgctttgttgaaggtcagcgtttgcaagagtggctgagcgaattacgcaaagcgccctatgtgaaacatacgctgcaggacgacaagtacgcgaccgttgccagcacgctcaagctggacgaaaacgaactcgaaggcagcttcttcccggacacgtacctttataccgccaataccagcgatgtcgccttactggaacgcgcgcatcaacggatgaaaaaggctattgatgaagtctggcagggccggatggataacctgccgtataaaaatgagcaggagatggtcactatggcgtcgattatcgaaaaagagactggcgtcagcgaagagcgggccaaagtggcctctgtgtttattaatcgtctgcgcgtggggatgcgtttacaaaccgatcctaccgtgatctatggcatgggagcggcctatactggcacgctgacgcgcaaagatctggaaacgccgtcgccgtacaatacctatatcatcagtggcctgccgccgggacccatcgcgatgccaggcaaagcttccttaatcgcggccgcccatcctgaaaaaaccgactatctctattttgttgcggatggcaaaggtgggcatacctttaccactaatcttgccagccacaacaaggccgtgcaggcctaccggcttgagttaaaggaaaaaaatggacagtaagtttatcgttattgagggcctggaaggcgcagggaaaaccacagcgcgcgatgcggtcgtcgcaacactgcgcgccagtggcatagaggacattgtctttacccgcgaacccggtggcacaccgctggcagaacagctgcgcgtgctggtcaagcagggcatagcgggcgagcaggtcaccgataaagcggaactgctgatgctttatgccgcgcgcgtacaactggtggaaacggtgattaaacccgcactggcgcgcggtgcctgggtggtaggggaccgccacgatctctcgtctcaggcttaccagggcggtggtcgcgggctggatgcggaactgatgcgtaccttacgtgatacggtgctgggggattttcgccctgacctgacgctgtatcttgatgtcacgccggaaaccggattacagcgtgcccgcgctcgcggggaattagatcggattgagcaggagtcactgcgcttttttgaacgcacacgtgatcgctatctggcgctggctgctgcggacgacagcatcctgacgatcgatgctacccagccgcttgagcaggtgacccgcgcgctgcaatccaccctgacggcctggctggcggaacagcaggcatgaactggtatccctggctaaatcagccttatcgccaggtcattggtcagcatcaggatggccgagcccatcacgcgctgttagttaaggcgattgatggtatgggtgatgacgcgctggtgtggggaataagtcgctggctgatgtgtctgcaccgtgacggattaaaaagctgtggccactgtcatggctgccaactgatgcaggcaaatacccatcctgactggtaccggctggaagcagaaaaaggcaaagccacgttgggcattgatgccgtgcgtcaggtaacggaaaaaatgtatcactatgcgcagcagggcggggccaaagtggtatggctaccggatgcggcacagctcagtgaagcggcggccaatgccttactgaaaaccctggaagagccgccggcgaatagctggttttttttgagcagccgggaaccgtcccgcctgctggccacgctacgaagccgctgcatggtgctgacattgccaccgccggacgaaaacgtgagtctggcctggctcagaaagcaaggcgcgcatgatgaggcgaacttactggcggcgctgcggctgagcgccggtgcacccggcgcagcgctggccctgctggaggacggactctggcaggcacggcaaaaactgtgcgattccctggcgagtgccctgcaacaggacattctgcaactgctgccagcgctgaacgctgacaacggtgcggcgcgtatcggctggctgctgtcattaatactggatgcgatgaaatggcaacagggcgcgagccagtggctcaccaacgtggatcgccaggacgtggtggcgatgctggcgcagcatttctcgcaaacggcgctcaataacagcgcccatgactggatgcgctgccgtgaaacgttgttacaggttacggcagtgaatcgtgaactcctgttaactgaccggttactgagctgggcggaccatctgaagccccatgtacctggctaatttactgagaaaaatatgtttattgttgattcccattgtcatctcgatggcctggattatgaaaaaaaccatcacgatctcgatgatgttattgccaaagcggcggcgcgtgacgtccggtttatgctggcgattgccacgaccttacccggctttagcaccctgaaagcgctggtaggcgagcgtgaaaatatcgtgctctcctgcggcgtgcatccgctgaaccaggaagcgccgtatgatgtcgagttattccgtcgtctggccgccgaccctcaggtggttgcgctgggcgaaaccgggctggattactactatcagcaggaaaccaaagcgcagcagcagcgatcgtttcgtgaacacatccgtaccgggattgcgctgaacaagcccattatcgtgcatacgcgtgatgcacgtgaagacacgctggccatcctgaaggaagaacaggtcgaacgttgtggcggtgtactacactgttttacggaagatcaggcgacagcggcaaagctgctggatatgggtttctacatctccttctcaggcattgttactttccgcaatgcagagcagattcgtgacgcggcgcgctatgtaccgctcgatcgcattctggtcgaaacggattccccttatctggcccccgtgccgtaccggggtaaagagaaccagcctgcttacacgcgagatgttgctgactatttagcggtgctaaagggcgtggacattgaaaccttagcggcaaccaccacccggaacttctctgagctgtttcatattccaatgagccgcctgaccagcgcatcctgatttatttcaggtgctgtaataaatacgaaatattattggttgaccctgtttttttcatacagggtcaatttttttgcctgaaaaatactcaataaaatcactattgttacgtgctttagcgttctgatttgcgaaacgtgatagccgtcaaagtaacgaagggtaatttattttacccttcgtaataaatcaaaatggcggataacgccaaccggtaaagcacctccctctttaccacgcgcgctgcgcgaaaaacgcacacatactcaggagtttcacgctatgtttaaaaacgcttttgccaacttacaaaaagttggtaaatcgctaatgctaccggtatcggttctgccgatcgccggtattttattaggtgtgggttcagccaatttcagctggttacctacggttgtctcgcatgtcatggcggaagcgggtggatcggtctttgccaatatgcccctgattttcgccattggcgtggcactgggctttaccaacaacgacggggtttcagccctggccgcggttgtcgcttacggcatcatggtgaaaaccatggcggtggtggcacctttagtgctgcatcttcctgcggcggaaattgaggcgaaacaccttgccgataccggggtgctgggcggcattattgccggctccattgccgcgtatatgttcaaccgtttctatcgcattaagttgcctgaatatctgggcttctttgccggtaagcgctttgtaccgattatctccggtctggcggcgattgcgatgggtctggtgctgtcgtttatctggcctccggtcggttccgcgattcaggacttctcccagtgggcggcttaccaaaacccggtagtggcatttggtatttacggcgtagttgagcgtgcgctggtgccatttggtctgcaccatatctggaacgttcccttccagatgcagattggtgagtacaccaatgccgcaggtcaggtattccacggtgatatcccacgctatatggcgggtgatccgactgcgggtaaactttccggtggcttcctgttcaaaatgtacggcctgcctgccgcggcgattgctatctggcattccgccaaacctgagaaccgtgccaaagtgggcggtatcatgatctccgctgcgctgacctcgttcctgaccggtattaccgagccaatcgagttctcgttcatgttcgttgcgccaatcctgtatgtcattcacgcgcttctggcaggtctggcattccctatctgtatcctgctcggtatgcgtgatggcaccagcttctcgcacggtctgatcgactttatcgtcctcagtggtaacagcagcaaaatctggctgttccctatcgtcggtatgatttatgccgcaatttactacaccgttttccgtgtcctgattgttaagctggatctgaaaacgccaggacgtgaagacagcgcaagcgaacagtcttcttcagcgaccggtggtgaaatggcgggcaaactggtggctgcattcggtggtaaagagaacattactaaccttgacgcctgtatcacgcgtctgcgcgtcagcgtcgccgatgtgagcaaagtggatcaaactgaactgaaaaacctcggtgcgcgtggcgtcgtggtggcaggttcaggtgttcaggcgattttcggcacaaaatccgacaacctgaaaaccgatatggatgattacatccgtagtatgtaaaaaggcgtagtgccgttttacaccgcgataaccgcgttgagtcactgctcaacgcggttttttttgccatttggatagaggatctgaaagaaggccgtgctaaccggctctcagggggatcagatggcttcgcgagtcacaaattttgccgtggtctgcaatagctggtccgataacagttgcaaatttgcggtcgccgtcgccgtttcttccacccgcgccgcattttgctgtgtatcgctgtccatctgcgcgacagcaataagcggccaggcaggcaataaaagaaagtgtgaaaattagggcggaaggcggcgagaaaaggggggaaatagttttcgcgcccaggcaaaccgcggaatgcgttaaacacagccagttggtataagaaaaaacagcctgaggttgaaagaaaacgaatttctcccgcatactgaggtattaccctccaggctaaaggaattgctctatggctgaagaaacgattttcagtaaaattatccgtcgtgaaattcccgccgacgtggtgtatcaggatgaactggtcacggccttccgtgatatttcacctcaggcgcccacgcatatcttgattgtgcccaatatcctgattccgaccgccaatgatgttgaggcggcacacgagcaggcactgggaaggatgttcacggctgccgcgaagatagcccgtgaagaaggcattgacgagcagggctatcgcctgatcgttaactgcaataaacatggcggtcaggaagtttaccatatccacatgcatctggtgggcggcaagccgcttggcccgatgctgtcacactgatcccttaagggaaccttgctatgcgttcatggttgatctgcctgcctgttgtgctgctgagccttaccggttgcagcagcgataaaccgatgattaatacgtcgcagtcgctggtgatggagtcctcggtgctctcggcgggcattattactgacgagccgacgctggatgaccacgacggtcagaaacgcgccagcagcgtactctacaatcagcgtgaaacgccggtggttgtgcattatcgttattactggtacgacgacaaagggcttgaaataacgccgcgtgaacccgcacagatcgtcacggttcccccgaacggaagcattgctgccgtctcgcaactgggtaacctgacggccagcaaggttcgtctctatatctatctctgaggactgttacgtgattcgcagtgttaatcgtactggcgcgctgttgatggcgcttattctttctggctgcgtgctaaaacagcagcaacctgcccccgttgaacccactcagcctgtggagccggttcagcctgttcctcagccggaacaaccggtacagcaaccgcaacctgttccacaaccgcctaagctggtgaccattaactgggatgccagcgttgagccgttggttgcgcagatggttcgtgccgccaccgttacaccgggcagcgtgttactggtcgatcgcatcaaaaacagcaccaatggtgcattgcagggtgaaaaggcaacgaacgctattcagaacgcgctgaataacaacggtaagttcagcctggtgtcatcagaacaactggcgcaggcgaaacaaacgctggggctgtcgccggacgacagcctgaactcgcgcagtaaagcgattggcctggcccgtaacctgaacgcacagtacgtgctgtacagcacggcgaagggcgacgtaaaagcaccgaccttacagatgcagctcatgctggtacagacgggcgaaattatctggtctggtgacggtgtcgcccagaattaatgcggcgtttctgcaactgatcacggcaactatcggtgagcaacaggtcactgtaacgccgttagcgggattaaccgggcagagctgtcacatcgtcactcagcagggacgacgtcttctccgtccggcgccacagccgccgataccttttgttaatcgccagcgcgaagggcggctactgcgtaaattacggcccagcggtctggtgcaggctccgctggcagctaaccgccatggcattattctgccctggcaggagggcgaggtcatgagcgatgccgggtttcgtgccgggcggcgtcaggtccttgcgctactgcaacagcttcatcagcagccgctcaccggttatcgtttatctctgttgcccttgctctggcaatactggcagcgttgccagcagcgacatcatcgctggctgcgtcagctacaacggttaacgcagcaaggcgagccgcggccattacggcttgctcctctgcatatggacgtgcatcccgctaacctgattcagtcagaacaggggctgcacctcattgactgggaatatgccgcagacggcgatgtggcgcttgagctggccgccgtctgtttgtcggacccgactcaacagatctactggctgcgtgactatgcggcgctcatgcagttaccgctggcctcactgcagcggcaggtttcacgctggcagccctggctgcatctgttaatggccagttggtatcaactgcgcgctgaacagagtggcgatgagcatttacaacagctggctcaacagagctggtcacagatttaacggcgttacgccgagagacaggattcaggttatgacaacacgttttcccggccccttaatgctggacgttgaaggtttcgaactggatgcggaagagcgcgagatcctccgccatccgctggtggggggactgatattattcgcccgtaactatcacgatcccgctcagttggcggaactggtgcgtcagattcgtgcggcctcgcacacacgtctggtggtggcggtggaccaggaaggcggacgcgtacagcgttttcgtgacggttttactcagttgccagccatgcagtcttttgcggcgctcaatgatatgaccacggcaggcgagctggctcagcaggcaggctggcagatggcggccgaaatgatcgccatggatattgatatcagctttgccccggtgctggacatcggccatatcagcgccgccatcggcgaccgcgccttccatgaagatccggctattgcgctggcgatggcgcgacgttttattgccggtatgcatgaggcggggatgaaaaccaccgggaagcattttcccggtcacggggcggtcagcgcagattcccataaagagacgccgcgtgatgaccgcagtgaagccgtactgcgtgagcacgacatggcgatattccgcacgctgattagtgaacaggcgctggacgccattatgcccgcgcatgtgatctatacagaagccgatccgctgcctgccagtggctcgccttactggctgaaaacggtgctacgtcaggagctgggtttcaagggcgtgattttctctgacgatctctcaatggaaggcgcggcggtaatgggcagctatgctgagcgtgcacagcagtcgctgtctgctggctgcgacatgattctggtctgtaacgatcgccagggcgcggtgagcgtaatggataatttgaccttgatcgaggcggaaccggttgtgcagttgtaccatcggggcacctttagccgggacagcctgaaggccagtagccgctggaaacacaatgcacagcagttgagtgcactgcaggaacgctggctggcgcataaagcagccttgtaacgccaggcggtaaacacaggttgcccggcatgatgacccttaaggataaccatgattatttatctccacggttttgactcctcaagtccgggcaaccatgaaaaagtgctgcaactgcagtttattgaccccgatgtcaggctcattagttacagtacgcgtcatcccaaacatgacatgcagtttctgctcaaagaaaccgataaaatcctcagcctgagcgatgacccaagcccgcttatctgtggtgtcggactgggcggatactggtcagagcgaattggttttttatgtgcgattcgccaggccgttttcaatcccaatctgttcccacatgaaaacatggaaggcaaaatagaccggccggaagagtaccaggatatcgccaccaagtgcgtgagtgactttcgtgaacgcaaccgtgaccgctgcctgacgattttatcccgccatgatgagcttctcgacagccagcgcaccgctgccttgttagatccttactatccgattgtctgggacgaaagcgaaagccacaagttccgcaacatctcgccgcatctgcaacgtctgaaagccttcaaaactgcggattaacatatcaggcacccaggcggtgcccgatcgcctgaccggtcctgccaggaactgtctgctaaatttgatgtacatcaattttctgaggctccgctctgcccgccatgctattctgcctgcagatagcgaaattatgtcgccaaccctatgtttattaaggtttaatttaaccattgattaacttttggttcacattttaagggggtctttgttgactacatctgttaagaaaattgttattgtgggcggtggtgccggcggcctggaaatggccacgcagttagggcataagctgggacgtaaaaagaaagccgagattatcctggtcgaccgtaaccacagccatctgtggaagccgctgctgcacgaagtggcgaccggatcaatggatgaaggcattgatgccctgagctatctggcgcatgcccgtaaccacggttttcagttccaactgggctcgttgaccaacatcaaccgtgagaaaaaagtcatccagttggccgaagtcgtcaacgctcagggcgaagtgttagtgcctgagcgcgagctggcttacgacacgttagtgatggcgctgggcagtacctcaaacgacttcggcacgccgggcgttaaagatcactgcatcttcctcgacagcccgcagcaggcgcaccgtttccataatgaaatgctcaacctgttcctgaaattctctgccagcgaaggtgcggtagagaaggttaacattgcgattgtcggcggaggcgcaaccggcgttgaactctcggcagaactgcacaatgcggttaagcaactgcacagctacggctacaaagcgctgggcagtgaggcgctgaacgtcacgctggtggaagcgggcgaacgtattctgccagccctgccgccgcgcatttcgtccgcggcacatcaggagctgtccaaacttggcgtgcgcgtaatgacacaaacgatggtgaccagcgcggaaaagttgggcctgaataccaaaagcggcgagtttatcgaagcggacttaatggtctgggcggcgggcataaaagcccctgactttatgaaagcgatcggcggactggaaaccaaccgcatcaaccagctggtggtgaaagagacgctccagaccaccctggatgaagatatctacgctatcggcgattgcgcctcctgcgccttacccggtgggggatttgtgccgccgcgcgcccagtccgctcaccagatggcttcctgtgcgctgcataacatcctgttgcagtatcagggcaagccacttaaagcgtatgtctacaaagaccatggttcgctggtgtccctgtcacgctttagcaccgttggaagtctgatgggcaatctgatgcgaggttccatgatgatagaagggcgcattgcccggttcgtctatatctctctctaccgtatgcaccaggtggcgttgcacggttatattaaaaccgggctgatgatggtggtaggcagccttaaccgggtcattcgtccccgtttgaaacttcactaaacgcatcagtaagattgtttttaacccgctgattttactattaactttcctgaagataatgaaatcagcgcggtattttagcctgtatcgactgctcagaactctcctaaaaggtggcactaagccgtcctgcacgattttcttcccattatctgatattgcaaaagctttacatctgtaaaacttatctcaaccaaacggcgagtcgcgcacgtcggttctgccagagctgtaagggatatcccagcggcaggaatgcgcggtaacactttcaggaggaacttcctgtgaataaatcaatgttagcgggtatcggtattggcgtggcagcggcactgggtgttgccgccgtagcaagcattaacgtgtttgatcgcggtcctcaatacgcacaggtgctgtcagcaacacctattaaagaatcgattaaacaaccgcgtcaggagtgtcgtaacgtgacgctgacgcaccgtcgtccggttcaggatgaaaaccgtatcgccggttcagtactgggtgcggtagccggtggtgttctgggccatcagctcggcggcggtcgtggacgcgacgtcgcaacggtagccggtgcgcttgcgggcggttatgcgggcaaccaggttcagagcggtatgcaggatcgtgatacttacacgacctctgaacagcgttgtaaaaccgtatacgacaaacaagaaaaaatgctgggctatgacgtcacctacaagatcggcgaccagcagggtaaaatccggatggaaaacgatccgggtacgcgtatcccggtagaccgtaacggacagttaatcctgaacggcgataaagcataagggacaagggcaaagattgccgcattgcggtcacacagcacagtatgaaacccaaaagcgcatccctggatgcgctttttttatggctgaggattgtgcgttaaccgaaaaggttgcctgattcgccagcctcacggcgcgttaaaaaaccgttgccagcacggttctgcgatgagccgaagcgggatcagccgggataacacagccttcactcctttttagtcggcaaggtcgcaacattaaccagccagcgccgcacggccacctcatcctcaggggacaacccggacagcaaaccggcctctgccgactgcacggcggctttactgcgtgccagcacctgcaatccgtcatccgtaagaccaatgatctggattcggccatgctcgtcgtgaggacgacggtggatcatgcctgcccgctcaaggttgctgacaatcacactcattgtctgcggcgtcagtagcgacagccgggccagctccgcgcccgatgcacccggataggcggcgagcatggtcagtaccgaaaactggggcagggtaaggccggtggcttttaaggcattttccatccgtatcttgtgaacagcatgtgcctggcggagcaggtagccaatgtggcctttcgtgcctcgcataccttcaccggggcctggcagcggcagattgtgcgatcctgacttgcgcataatataagaactcttatattgttgttcgagttcttatattaacagacaggattatttatgacatcgcattctcacaaccgaagtgactggtccacgtttgagcgggcggcgccggaggttgtcgctgccctgagcatgctgggcaaggcggttgataacgctggcctggataagtcattgactgaattgattaagctccgggcgtcacagcttaatggctgtgccttttgcctgcagtttcatctcaacatagcgcgtaaaacagggctggctgcggctaaaatcgatctggtggcgacgtggcgtgatgcaggcatttacaccgagcgtgaagcggcggcgctggcatggaccgaagcattaaccctcatgtcacaacagccggtgccggacgcgttgtacgataacctcagcaccctgtttacaccgcaggaggtgatgttcctgacctcggcaattggggccatcaatgcctggaaccgtatcgcaggtgcgttgcagtttgccccgccgctggcccgataaagaagattcgggcagcgccttacacgcgcaatttctgtgaaagccgcacaggctcaataactacgcgggaattcaggcaaaaaaaagccgcctttgattaaggcggctttatgcacgcactgcggtgctgttcgccatgtggcgggctaggaggcgatacggttttccattagctgggacataaacgactgcacccactccatccgcaccttgcgttctgccagttcacgggtgaagcgcaggcgcgtcgggccttcaagcttccactgccgcgcatctttttgcagcaggccgatcagccaggccgggtccacacagttctgcggcgcgaaatcgaaatagccacctttatcgctggcttcgattttacgcacgccaagagccttggctttcatccgtaatacggcgatatccagcagattacgggccggatcgggcagcagcccgaagcggtcaatcatttctaccttcagctcctgcaactcatcttctgcttcggcactggcaatgcgtttatacagtgacaggcgagtattgacgtccggaataaagtcttccggcagcagggcgggcatccgcaattcgacttccgtctgattgctggtgagatcttccagtgacggttcccgacccgctttcagggcatcaaccgcattttccagcagttccatatagagtgaaaagcccagggtttccatctgaccactttgctcttcgcccaacagttccccggcaccacgaatttccagatcgtgcgtggccagtgcaaagcctgcgcccagatcctccagtgatgcgatggcttccagacgtttttgcgcgtcggttgtcatggctttcgggtgcggggtcagcagccaggcataagcctgatggtgtgagcggcccacgcgcccacgcaactggtgcagctgcgccagcccgaagtggtcggcacgctcaatcacaatggtattggcggttgggatatcaataccggtttcaatgatggtggtacacaccaggacattgaaacgctgatgatggaagtcgttcatcacccgctctaggtcgcgctcgcgcatttgcccatgaccgatggcaacccgtgcttctggtaccagttccgccagccgctgagcggctttctcaatattttcgacatcgttgtacaggtaataaacctgcccgccgcgcaggacttcacgcagaatcgcctcacggatgaccagatcgtcatattcccgcacaaaggtttttaccgcgagtcggcgcgcgggcggtgtggcgataatggacagatcgcgcatcccgctcatcgccatattcagcgtacgcggaatgggcgtggcggtcagcgtcaggatatcgacatcggcgcgcatcgccttaatgcgttctttgtggcgaacgccgaaccgatgctcctcgtccacaatcagcaggcccagatcgtgccacttgatatcgctcatcagcagcttatgggtgccgataagaatatcgatcttgccttcgctggcttcctgcaatatctgattctgctctttggcgctgcggaagcgggacagcatttcgatacgcacgggccagttggcgaaacggtcgcggaagttatcatagtgctgctgcgccagcagcgtggtcggcaccagcacggcaacctgcttattgttttccaccgccaggaaggcggcgcgcatagccacttccgttttaccgaagcccacatcgccgcacaccagacgatccatcgccagcggctggcacatatcgctcagcacggcattgatggcctgggcctggtcgggcgtggtttcaaacgggaagctttcgcagaagagctggtactgctcgcggtcgtgcttaaacgcatagccggtttttgccgcgcgctgcgcgtaaatatccagcagctcggcggcgacgtcacgcactttctcggcggctttctggcgggcgcgtgaccaggcatcactgcccagcttatgcagcggcgcgttttcatcggcaccgcccgcatagcggctgattaagtgcagcgaggaaaccggcacatacagcttggcatcgttggcgtaggagagcatcaggtactccgcctgtatgccgcccgcttccagcgtggtcatgccgatatagcgccccacgccatgctcaaggtgcaccaccggctgaccggggtgcagctccgcaaggttgcggatcaatatgtccggattaatggtgcgacgcgtatcctgacggcgacggatgatgcgctcgcccaacagatcgctttcacaaatcagcgccaggttgccttgtgtatccacaaagccacgctcgctggcaccgatcatcagggtatgctgcccagcgctgacttcattcagatgatgaatcggcttggggcgcactttaatccgcgccagtagctcttgcaggctttcgcggcgaccttcgctttccacggagaacaccacaccgccgctgaactgctccaggaactggcgcaggttatccagcggggctttcgcctgcgcctgaaccgataaatccggcagggattcataaccaaggttggtattggcggctttcgctggcagaacgtcgtgggtcatacggatgcgcggccaggctttcagctcgcccattaatgcatccgggcgcagccacaacgtggcaggctcaagtagcggacgcatggggtcaacacggcgattttcatagcgcgcgttggcatcattccagaatcgttctgccccgccttccagatcaccacagttaacaatcagggtgttgtcgggcaaatagctaaacagcgaaggtaaaggctgttcaaagaacagcggttgccagtactcgataccggcgggcagggtgcctttgctcacctgctgataaacatgctcggcctcacggcgcacatcaaaaatttcacgccagcggctgcggaacagctcaatggcgttcttatcgctgggaaattcatgagccggcagcagattaatcgcgggaacggcttccagcgtgcgctggctgtcgacgtcaaacaggcgcaggctgtcgatttcgtcatcgaagaaatcaatgcggtaaggttgctcgctgcccattgggaacagatcgagtaaagcaccacgggttgcgtactcaccgtgctccatcacctgatccacatggcgataacccgcctgctcaagctgatcgcgcaggcgatcgcgtgacagtttctggccctgttgcatgaccagtgcatgaccgtgcaggtagctgtgcggacaaacgcgctgcatcagcgtgttcaccggcataatcagcatgccgcgctgcagggtgggcagttggtacagggtggaaaggcgtgccgaaatgatgtcctgatgcggcgagaagctgtcgtagggcagcgtctcccagtccgcgagatgcgcgaccggcaagtcggtaaactgacggatctcgtccagcagatgcagggcggtttgtgtatcgggtgtgatcattaacaccggaccagcatggcgctcggtaatgctggcacactcaaccgcgtgcgcagcgccagtcagctggccgagctggcggtgatcgccagatttcacgggcagggtatagcgagtcggttcggacatgagatctcgaggttgctccatttttaccagggcgtaatcattccataatacgccatggggatcacctctgcgggagattttttctaccgcttcgccttaaagcaggcgtgactaaagggttgctgtgtgtaaatcttttttgcgaacaacgttcgcaggaaagtcaaacgggtacatcagagtaacgttcattgccgtcatctctttacggtaatgattatatcggctctcacgctgcatcatcgtacgattaacatcatctttataggctaatcctgtgcatcaacccgctgataacctattctgatacaactttgcagcagactcagagggttagaggtttcataaagtgagccgctcctttatcatcctctctacttattttccagcaactgtacattggattccatgtatcaacctgtcgcgctatttatcggtctgcgctacatgcgcggaagagctgcagaccgtttcggtcgctttgtctcctggctctccaccattggtatcacgcttggcgtgctggcaatgattactgtgctgtctgtgatgaatggtttcgagcgagagcttgagggcaacatcctgggcctgatgccgcaggcgctggtgaccagcgacaaaggcagcattaatcctcaacaattcccggcatccgacctgaagcttaaggggattaaccgcatcgcgccgttaaccacggcgaacgtggtgttgcaaagctcacacagcgtttcggttggcgtgatgttaggcattcagccggatgaaaaagacccgctgacgccttacctcgtgaacacgcagcaaagcgtgctacagccggggcaatacaaggtgattctgggtgaacagctggccgcgcaactgggcgtcaaacggggtgacatgctgcgcttgatggtgccgtccgtcagtcagtttacaccgatgggccgcgtaccaagccagcgtctgtttaccgttgccggaacctatgcggctaacagtgaagtcgatggttaccagattctggttaatcagcaggatgcctcacgcatcatgcgttatccggcggggaacattaccggctggcggctgtggctggataaaccgttacaggttgacagcgtcactcagcaggccttaccgccaggcatggtgtggaaggactggcgcgaacgcaaaggggacctgttccaggccgtgcgcatggagaaaaatatgatggggctgctgctgagcctgatcattgccgttgccgcctttaacattattacctcgctgggcctgctgattatggagaagcagggcgaagtcgctatcctgcaaacgcagggattaacccgccgtcagattgtcgccgtctttatggtgcagggtgccagtgccggcatcatcggcacgctgctcggtgcgctgcttggcgtgctgttagccagccagcttaatcatctgatgccggtcattggcctgttcctggatggcgcggcgctgcccgtcgatatcaatgtgtggcaggtcgtcactatcgcctttagtgcaatgattattgcgctgctttctacgctttacccttcatggcgcgccgccgccgtccaacccgctgaggctttacgctatgagtaactctcctttgttgcagtgccgtgacctgtgcaaacgctatcaggaaggcagcgtgcagaccgacgtgctgcgcaatgtgacctttgatgtgcaacccggtgaactgatggcgattgtcggcagttcgggttcagggaaaagtaccttgttgcacctgctgggcgggctggatgcgcccacctcgggcgaagtggtgtttgacggtcgctcactcaacggtatgtcatcgtctgccaaagcggagctgcgcaaccgcgaactcgggtttatctatcagttccaccatctgctgccggactttaccgcgctggaaaatgtcgcgatgccgttactgattggcaaagtgaccaaaggcgaagcgcaaacccgcgcgcgggagatgctggcggccgtggggctggaacatcgcgccgcgcatcgcccgtcagaactctccgggggagaacgccagcgcgtggctattgcccgtgcactggttaaccgcccgcgcctggtcatggccgatgagccgaccggtaacctggatgcccgcaacgccgatgctattttcgaactcttaggtgagttgaatgtgcgtcagggcaccgcgtttctggtggtgacgcacgatctgcatctggcgaaacgcatgtcgcggcagatggagatgcgtgacggtcagttaagcgaccggattatccttgcaggagctgtctgatgggatcgtcgttatcgctgctgttggggctgcgttttagccgtggccgccgtcggggaggaatggtttcactgatctccgttatttcaaccatcgggattgcgctgggcgtggcggtattgatcattggtctcagcgccatgaacggatttgagcgtgagctaaacaagcgcattctggccgtcgtgccgcacggtgaaatcgaagccgtcaatcagccttttcagcgctggcagtcgatgattgcgcccattgagcaggttcccggcattgcggcggcagcaccctacattaactttaccggactgattgaaagtggcgcaaagatggaagcgctgcaggttaaaggggttgatcccgcgcaggagccgcgtttgagcgcgcttccgcagtttgtcactgacaatgcctggtcgacctttgcgccgggtaaaaagcaaatcatcctgggtggcggcattgcgcaggcgcttaacgttaagcagggcgactggatcaccatcatgatcccgaataatgatggcgataataagctcctgcagcccaagcgtatccggctgcaggtcagcggcattctgcagctgagcggcatgttggatcacagcctggccttagtgccgcttgctgacgcacagcaatatctggatatgggcgacagcgtcaccggcattgccctgaaaatgaacgatcccttccaggcgtcaaaactggtacgggcggccggagaagtgacgcactcttacgtctatatcaaaagctggattggcacctacggctatatgtaccgcgatatccaaatgattcgcgccatcatgtatctggcgatggtgctggtgattggcgttgcctgtttcaacatcgtttccacgctggttatggcggtgaaagacaagagcagcgacattgccgtactgcgcacgctgggtgccaaagacgggctgatccgcgccatttttatctggtacggcctgctggcaggcttactgggtagcgtaagcggtgtggtggtcggcgtgctggtggcgctcaacctcacttcgctgatgaaagggctggaatccctgaccggtcaccatttgttagcgggcgatatctacttcatcgacttcctgccgtctgaattacactggctggacgtgttttcggtgctgattaccgctattgtgctaagcctgctggcgagttggtatccggcgcggcgcgccagtcgtatcgatcccgctcgcgtgctgagcggacagtaagcgcgtcatgcggcaccctgggcgtcgcatgactgatccgcgctgacagcagggcgaattaacgttacaccgatcaccgggcccgattgccctaaatatattgacccgcggtggctttttttttgcgaccgcaccaggagactttatgcgtacacctcgtcgccgtttacgacttgcccgcctgaagaaaacgcgccggaaagtgcatcagcgctttcgtcagcgtattttcgaacgcgatcgccaggccgagctggcggcgcacccgttgccgcgaatcgttgtcttaacgggtgctgggatatctgcagaatcgggcatcaacacgtttcgtgccgccgacggattgtgggaagaacaccgggttgaagatgtcgccacgccggaaggcttccggcgcgatccggccctggtccagcgtttttataacgctcgccgccagcagttacagcagccggaaattcaacccaatgccgcccatctggcgctggccgagctggagcaggtgctgggcgataattttctgctggtcacgcagaatatcgataatttgcatgagcgcgcgggcaacagccgcgtgctgcatatgcacggtgaactgttaaaagtgcgctgtgccagcagtggtcaggttatcgactggcaggaagatgtgacgccagacgatcgctgcacttgctgtcagtttccctcggtgctgcgtccgcacgtcgtctggtttggtgaaatgccgctcggcatggaagcgatctaccaggcgctggagcaggcgaacctgtttatcgccattggtacctcgggccatgtctatccggccgccgggtttgtccacgaggcaaaactgcagggcgcccatacggtagagctgaacctggagcccagcctggttggcaatgaatttgccgaaagtcactatgggctggccagcgacgtggtgcctgcctttgtacataaactgttgcacgggctacacaaataaagcatcacgccacggaataaacagcggaccgttcgcccgctgtttattccgtttccggtagcattccgtcattctctgttttcctgatcgcctcagcgataccgccatatcatgttgttatcgctcgcgatgattcggtttacgccgtgcttaacctgtccctgttcagctcacgttctgcgcgcggtgaaaccggccctgttttcgcgccgttggaccacaacaggctgtggcgagggaaaacctgagcaacgtgccgcaaaaaaacagccattgcagggttttttatgcccgttggcattcttaatttgccgcagcagggctaacctgaacgataatgatttgacgcaacgcgacctcttgcccgtctgttaataataattggcggcaatttttaaggatgatatatgaagcaattacttgaacgctttttgcgttatgtggcagtggaaactcaggcgaaacctcaggcgcgtcaggtgcccagcagcgaagggcaatggatgctggcccgtcagctgcaggaagagctactggcgttgggctttgtggatgtgagcctgagcgatcactgctgtgtgatgggcacattaccggcaaacgttgactggccgacgccggttatcggttttatttcacacatggacacgtcgccggatttcaccgcgaaaaatgtcaatccgcagatcatcgaaaattaccggggcggcgatattgcgctggggaatggcgatgaagtgctgtcgccggtgatgtttccggtattgcataagttgatcggacacacgctgattaccaccgacggtaaaacgctgctgggtgccgatgacaaagccggtattgcagagattatgacggcgatggcgcggctggcagaaagcgatattccgcatggcgcgattcgagtcgcctttacgccggacgaagaaattggccgtgggacatcgcatttcgatgtcgaaggctttgcggctgactgggcttataccgttgacggcagcgatgtgggcgagttcgaatacgaaaacttcaatgccgcttcggcgttggtcaaagtggtcggtaataacgtccaccccggctctgctaaaaacgtgatggttaacgcgctggagctggcaacccgtttcaatgccgcgctgcctgctggcgaaaaaccggagtgcacggacggttatgagggcttctttcatttgcaccagatgaaaggcacggtcgagcatgctgaaatgcactacatcatccgtgatttcgatactgaagccttcgaacagcgcaaaaacacgctgcaacaggtggcggctgacattaacaagggattacatccggactgctctgttaccgtggagatcagcaacagctatcgcaacatgcgcgaaaaagtcgaacctttcccgcatatcattgagctggcgctgcaggcgatgcgcgactgtggcatcgagccggtggtgaaaccgattcgtggcggcacagacggttcgtcgctgtcatggaaagggttaccttgtcctaacctgtttaccggtggctacaactatcacggcaaacatgaatttgcctcgctgaatattatggcgcagtcggtggatgtgattgtccgtctggccgagctggcgggacagaaaaaagcctgaataaaaaaggccgcgctgtcctgaatggaacagcgcggcctttacatccgttgcaacggacaagggcttattcggcgctaaaaaaccagtaaccggcgttcaccaggccagcgatctgtgccagcacggcaggatcgtccagcgcatcacccagatccgcaagggcgatttcatggttatgtgccagcacggtcatcacggccgggtgcgcgcactcaactcgttcaccgttgatataaacggcattgcccagcgtcagaacacgtaagccgccaaggcgagacaggacatcaccctgctgcagcgcatcgtagatctcatccggctggtaaggcggttctggcggtgccacgtcgagttcatgacgggactgtgaaataaactcacctaaccattgctcaaagtgttccggctgattcacgacatccagcatcaccttgcgcaggccttcaacctcctgcggcagaatcagcgacgggcaatcacgcgtgggcacatccggatcgctgtaacgcaggctgcccagttcattggccagcgcgtaatcggcaaagccgctaatcagctcacgcccgcttggtgcgcggaaaccgaccgagtaattcagggcattttccagcgagtagccttcatgcgggaaccccggtggaatatacagaatatcgcccggttccatttcttcatcgatgatggcgtcaaatggctcgacctgaagcaggtctggatgaggacagtgctgtttcagcggcactttttccccgacccgccagcggcgacggccggtgccctgaatgataaagacatcatactggtcaaagtgggggccaacgccaccgccgggtaccgagaaggagatcatcagatcgtctaaacgccagtccggcagaaagcggaaagggcgcatcagcgcggcggaaggctcatgccagtgattcaccgcctgtaccagcagtgaccagttgttttcaccgaggtgatcataactttcaaacggaccgtggctgacctgccacttgccgttttgctggctgaccagacggctgtcgacctcattttccatggctaatcccgccagttcatcaggcgagaggggatcgataaagttcttgaagccacgcttcagcaccaccgggcgcttttgccagtaacgctgaataaaatcgggccagttgagatcgagctgataatccataaagagattccgctaagggctgtaaatacctgccagtataacagcccacagcctgaactactcgcggcgatgttccatttcctgacgctcaaacaccacttccatgcgggcaccgcccaacgggctgctggaggcgataaccttaccggcgtactgttcgagaatatcgcgcaccaccgccagtcccagcccctgaccgggacgcaaggtatccgctcgctgcccgcgcacaaaaatcatgtcgcgtttgctctcaggaatgcccggaccgtcatcatcaatataaaggtgcaaggcgtgctcggtttgatgggcgctgacttcgataaattccagacagtatttgcaggcgttatccaacacgttacccagcacttccataaaatcattttggtcgccaaaaaaggtggtttccggcgagatatccagggtgatttccacgcctttgcgctgataaaccttgttcagggccgaacacaggctgtccagcaaacctgataccgaatgcagatcgcgctgcaggggattgtgatcggcctgcatgctggcacggtgcaggtaatatcctacctgctgcgaaatgcggctgatctgttccagcatgatcggctcggccttttccaccgtcagctctttacccccgcgcagcgaacgcagcgtactctgtaacaccgccagcggggttttcagactgtgggttaagtcagccagcgtcgtacggtagcgggtgtaacgctgacgctcattggtcagcaacaggttaaggttgcgcaccagcgagcgtaactcctgcggcggattatcgtccaggttttcacgctgcccggtttccagctcgcgcacctgaagcgttaagtgcccaatcggacgcaaactccagtgtgccgccagccagagtaacggcacgattaaaatcaggttagccgccagcacatagctgaaccatgaccagaccacatcggaatgctgaagctcctgcggaatggtatcgaccaccacaatggttaaggcgggcaggtttgtcgtggcgtcatagcggtttaccgccaccgagtgggtaaaggtgtcctgatcgtcgtcgtcattatcccaggcatgaagctgctgctgcgcgctaaggttatcgcccatggcggcccggctggtactggtgctggtgtctatttcataaaaatcgggctttaacagccattcgggttggatcttttcacgaatttccggcacatcgcgctgttgccagagcagcttgccatgttcatcgtaaataaacaccagggtggggaaattgagcatggtgcgctcaggctgggcgatggtgagcttattatctttccactgtgccagggtaaaaaataaattgctctcgccgcgcatgacgcgataggtggttttatcaaaactcaccacgtaaccaatgaccgcaaccatgccataagaaagggagaggattaatacaatggctgcggaggccagtaagaagcgcgtccgcagcgagatagggcgatagcgtttaaaccacgacatcatcagagatcaaagcggtagccctggccgcgaacggtagcgataacttcatcagaatgcagcgcaagaatttttttacgcaggcgtcccattaatacatcaatcgtgtggctttcacgtaactctgcatcgggataaagctgcagcatgagggaatctttactcacgactttgccggcattgcgaattaatgtttcgacaatcgtatattcaaacgcggtcagcttaacgggatggtcgttaatggtgagttcgcgacgggataaatcgacctgaaaaggggccatagcaataatctgcgaggcatgaccgctgttgcggcgcattaatgcctgcaaacgagcggcgacttcctcaatatgaaaaggcttcgtcacataatcatctgcaccggcttccagcgcttccactttcgcctgccagccttcacgcgcggtcaacaccagaataggctgacgcaccgcgtcattgcgccagcggcgaattaaagacatgccgtcttcgtcgggtaatcccagatcaaccagcgcaatatcgggcagatgttcctggaggaaataatcggcttctttggcatcttcagcagcatcaacctgatgacccatttctcgcagttgtaccgaaagatggtggcgcagcagggcattatcttccacaaccagaacacgcataggatttcctttagcatcagatcgaaacgaattttaataagtatatgcgaaatgaactaaacagcaggttaacgcagaccggcgggaaccggtctgcaaagaggatattatttcagatcgtcaaccatctgtatcgcgcggccaatataatttgccggggtcatctgttttaagcgaattttttcttcttccggtagcgccaggctgtcgataaaggcctgcataccggccgcatcaacgcgtttgccacgggtcagttctttcagtttctcgtacggtttttcaataccgtagcggcgcatcacggtttgaatcggctctgccaggacttcccagttgtgatccagttcgtcgagcaggcgatcgcggttcacttccagcttagaaatgcctttcagggtcgcctgataggcgatcagcgcataaccgacgcccacgccaaggttacgcaggacggtagagtcggtgagatcgcgctgccagcgtgaaaccggcagtttgcttgccagatgctgcattaccgcgtttgccaggcccagattgccttctgagttttcaaaatcaatcgggttaactttatgcggcatggtcgatgaaccaatttcgcccgcaatggttttctgtttgaaatggttgagcgccacataaccccagatatcgcgatcgaagtcgatcaggatggtgttaaagcgggcgatacagtcaaacagctcggcaatatagtcgtgcggctcaatctgggtggtataaggattccaggtaatgcccagcgaggtcacaaactcttcgctcagctgatgccagtccgcttccgggtaagcggcgatgtgggcgttatagttaccgacggcaccgttgattttccctaacacttcaatctgcgacagctggcgcagttggcgttccatgcggtaggccacgttagccatctctttacccatggtagagggcgttgcgggctgaccgtgggtgcgtgacagcagagggatatcacggtattcctgtgccagaccttttactgcggcgatcaactgctgccagtagggcaggatgacatcgcggcgcgccgtttccagcattaaggcgtgagacaggttgttaatgtcttcagaggtacaggcgaagtgaataaattcagacaccgcatgcagtgcaggcacgtcagcgactttttctttcaggaaatattcaacggcttttacgtcatggttggtggtgcgctcgatggttttaatgcgcgccgcatccgtttcgctgaaactggcaacgattccgtcaaggaaagcgtttgcgtccgcatcaaatgcaggaacttccttgatctctgcggtcgcagccagtttttgtaaccagcgaacttcaacctcaacgcggaatttcagcaaaccaaattcgctgaagatcgcgcgcagcgggctgactttatcgccgtaacgaccatcgacaggtgagacggcggtcagagaggataattccatcagtgcaactcctgatttatttaacggtgtttgccgcacggactcagtaagtcagtggcaggcgggataatagggctttggcttcgcgcagtaagcgttggcgcgaaaacatcagttgcagtcggcctccgccaacctgctgccacagtacggcggcacgaataccggccagcagcgtggcgcgaactttgctttgtaacagggaattctgcaggacggccggcgagccggtgacctgaatacgtgggccgagtgggctgatgacatcaacataaatgcccgccatcgcgctcagaatggtgtcggattccagttcataatgcgccagctggcgatcgagttggctgatgcgctgggccagcgtggccatggcctgcttgttggcgttgagcttacgctccagcaccatcaggctcagtgtgtaacgggtcagctcggcgctggcacctttacggttgctgctgttcagcaccgccatcagggtttcaagcccaaggcgcaggttggcttcattgttaccgaacaccgccagcgtggatgtcgggttaagatccagtacgctgcgcagggaaaccgtcagcgcttcaggctggcagtgcccctgattcgcgagctgctgaaccagatgggcagcctggcaaatgcccgccagcgcaagggtaatttcctgatagttttttgccacggtcactccagtttacgcgttattagcgccggtattatgcggcaacccaaggcaaacgttcttcaatgatgccgccacccaggcagacatcaccaaggtagaacaccgcagactgccccggtgttaccgcggcaaccggttcgtcgaaccgcacttcaattttgtcatcgccctgcggaataatctcgcaagggatatcggtctggcggtagcgggttttaaccgtacaacgcagcggggcgctaaccggcagacgatccacccagtgcagctgctgagcaatcaggcccaccgacatcaaccgcggatgatcgccaccctgcgccacgattaagcggttacgcgcgacatctttatcaaccacgtaccagggatcgtctttgctttctttcatgccgccgatgcccagccctttgcgctggcccaacgtatggtacatcaacccctggtgctcaccgacaatctggccatcaacggtttcgatttcacccggttgagcgggcaggtagcgtgccaggaattcgcggaatttgcgttcaccgatgaaacaaatgccggtagagtcttttttctttgccgtgattaattcaagctgttcagcaatgcggcgcacttcgggtttttccagctcgcccaccggaaacaggctctgggcaatttgttcatgactgagcgtgtagaggaagtagctctggtccttgttaccgtccaggccgcgcagcaaatggctacgtccgtcgatatcctgacggcggacatagtgtccggtggcaataaagtctgcgccgagatcttctgcggcaaactccagaaacgctttgaatttaatttctttattacacaggatatcggggtttggcgtgcggcccgccttgtactcttcaaggaagtgctcaaagacgttatcccagtattctgcagcaaaatttaccttgtgcagtttaataccaagtttgtcgcacacggcttgtgcatccgccagatcgtcagcggcggtacaatactcctcgccatcgtcttcctcccagttcttcatgaacaggccttctacctgatagccctgctgttgcagtaaccaggcggaaacggaagaatcgacgccgccggacatcccgacgatcacttttttctggcagttatcagacatcacaagctcgcaaaacaataaaacaggcggcgcattctatcacgctgaagtcgggtgcgcacctgcatgaaacggccagttgaacgggctgatcaggtctaacgggtagcgcacgccctgttgccatctgcgcacgctctctgcgactaacggcgaacgcaggttagacgccgtcagtatctgctctggcgccagccaccagcagcaatcaatgtcgctgtcctgcggcgcggtaggcagggtggtgtccagatccagaccaaacagaaaccgcacaaaaggcgtattatcgggggcaatccactggttaataccaataaaatactccacagcggcctcaataccggtctcttcatagagttcacgctgcgcggcttccagaagggtttcgtccgcttccagatgacccgcaggttggttccaggttgccacgccgttcacccgttcttcaacaacgagcagtttaccctgagcctggaccagacaggctacggtgacatgcggtttaaacatcaatcctccggaattgttaacttgaagttatggaaatgataacagtgcttagactaaggtgctgatatcacgccattcgccaggggccagattatccagtacaaagtcacccatcgcatagcgcaccaggcgcaatgtcgggaagccaatatgggcggtcatgcgtctgacctgacggttacgcccttcaaacagggtgattttcagccactgcgtcggtatcgctttgcgctcacgaatgggcggctggcgtgcccatagccagtcaggctccactactttttcaatgccggctggcagcgtaaggccatctttcagcgtaaccccatcccgcagtggctgcagatcctgctcttccggcacgccttcgacctgcacataatacatcttgccggtgcgcttgccgggctgggtcagcgcggcctgcaaggtgccgtcgttggtcagcaccatcagtccttcgctgtcgcggtcaaggcgacctgcggcataaacctcgctgacatcaataaaatcttttaacgtgcggcggccggcttcgtcggtgaactgcggcaacacatcaaagggtttattgaacaggagcacgcgccggacggcagggggcgatgcagccttgcgctgcacgggacgggtttgtcggctgaatcgtttatttggttgagaagtctgattagtttttcgcatacgctttgcagtctgaaacattcagcgcattataacgcgaaattgcggtgattggcgtagcgtcaatattcaagtagtattgacgcgcatcttacaaatcattaacaaaaaatcgctcgaaggagaggttaatggaaagcaaagtagttgttccggcggaaggtcagaaaatcaccctgaatcaaggtaaactggatgttccaaataacccggttatcccttacatcgaaggggatggtatcggtgttgatgtttcaccagtgatgctgaaagtggttgatgccgctgtgaaaaaagcctacaacggcgagcgtaaaatctcctggatggagatttataccggtgagaaatcggttgaactttacggtcaggatgtctggctgccgcaagaaaccctcgatttaatcaaagaataccgcgtagcgatcaaaggtccactgacaacgccagtgggcggcggcatccgttctctgaacgttgcgctgcgtcaggaacttgatctgtacgtttgtctgcgcccggttcgttactacaccggcacaccaagcccggttaaacgtcctgaagataccgatatggtgatcttccgcgaaaactccgaagatatctatgcaggtatcgagtggaaagcgggcacggctgaagcggacaaagtgatcaaattcctgcgcgaagaaatgggcgtgaagaaaattcgcttcccacagaactgcggcattggcgttaagccatgttcggaagaggggaccaagcgcctggtgcgtgcggcagtggaatacaccatcaccaacgatcgtgattcactgaccctggttcataaaggcaacatcatgaagttcaccgaaggctcattcaaagactggggttaccagttagtgaaagaagagttcggcggcgagctgatcgacggtggcccatggatgaagttcaaaaatccaaacaccggtaaagagatcgttgttaaagacgtgatcgctgatgccttcctgcagcaaatcctgctgcgtccggctgaatacgacgttattgcctgtatgaacctgaacggtgactacatttccgacgccctggcggcgcaggttggcggtatcggtattgcacctggcgcaaacatcggtgacgaatgcgcgctgttcgaagcgacccacggtacagcacctaagtatgccggtcaggataaagtgaacccaggttccgtaatcctgtcagcggaaatgatgctgcgtcatatggaatggttcgaagccgcagacctgattgttaaaggcatggaaggcgcaatcgctgccaagaccgtgacctatgacttcgaacgtctgatggatggcgctaaactgctgaaatgttcagagtttggtgacgcgattatcgcgaatatgtaatttagtctatggactgaataagagcgggagcctgttggttcccgtttttttatgagcgctctggcgtttatcaaaattatttatcaaaactacgctaccacccttcaacgttaagtcttttttgactgaactcccgcaggattaacgacaacggtcagttagtaatacctgttgtcttactgtcacacttcccgcttcgccactgtgctgcaaactctgatggcgtctgataagtcagtgccgaatgtgggcgacgctcgttataatcctgccgccagtcgttaatggttttcctggcatcaacaatatcgctgaacccgtgtttattccattcatcgcgacattgtccgttaacgctctcaattagccgttctgtgttagctcgcctgctgaataagccgaagctccacgtcatactcaaataacgactgacccactgacctagcgcccggcagataaactccgggccatgaggggttcttattgcagccggatagccacggaataacgcaatactgtccagaacaggtgtgatgtgaacaccctatatggctaaggcgacagttatacacatggcacgccagaaacgcttataaaatcacagcacgtgacctgacacgggcctttaccatcaaggtaaaggcgcttacgaaccgcagcaaatcaacgctatccctgctgatttaaaaaacgtttcgcgagggtgaagagggtgaaaactattaacagtccaccgcctgaaatattgacatattttttaagcctctgcggatttctacctttagcagaaaatatcaagatatggctgacgatgcagagccacaggcccatcaccaccacgtggagggatgccagaatcagataattccccacaccgccatgctggccagcaaatctggaaacgactgtgagataaaaaacaatggctttgggattcagtaggttaaccattaacgcctcgccgaccgaaatggaacgggtcctgcacagagtattatcccgctgcgcgttcacgccacttctgatgagcatcaggcctaaccagagtaaataaaccgtgccggccatttcaagcaggttataaacgccgggtaaagaaataatgatggcggtaagtccgagaccaatcaggagtgcatgaatatatattcccacggcggtaccggcgagcgttcgcagaagaccgctacgtccaccagcgagtgcactgctcatgacaagtgtgaagcttgccccaggagaaagcgcgacgggtaagagtgctggcacgaagccaataacatcaatatccataaattcagctttgtcgttaaaagtaaaaatttaaaaaaggatatcatcaaaatattttattactatttttacgctctattttaggagaaagaaagtgcattgaagatacaggcgttaaagccatttaaacaaatggtgacgtatgtcactttttattaatcgaaaggaaatgccactgaagctacggcagccaatgaaatcataaagcatgggggtgtttatagtatttatgtttacttagggaatatcttttgcattgtgtttttgtaatcgatttcaataaaaaattggaaatgtaagactgtctatccctgataaaaattgaaacttatgggtaaagttatagctatgataaaaatcagttcagagaggtgaaaggaatttagacggtaaggtgcaagccatcaagccagtaattgtaataaagtgttagttttaatcctgtactgaaaaacagatggtggcgctattttatccggcaaaagttttatttaaatatatattttgttgaaaagtttgcgtttgtgaatcatttcatacacttattaatataatttaacatatctatatctgaattcagcattattcataagctttttattaagagtaatcttaaaaaaaaatctcaaaatcacctaaaaaaagcaaagcggcttgttttatttatataattcatatacttacaaattgatcaatcattgatcacataagtattgctttagtgtttaagttaaattatgtttttatgacacatgaaatgataagtgttattaacaataaccggattgcaattgatccctctcaagctgtgcacatgtggcgaatactacccgatatgaatctggtggatataaagatctcgattttaaaggttttttcttaaaaggagatataacctatggctggtgaaacagtttttccaggcctggataatttcagtttttcattgcctgtaaaaatacattttgaaaagggggcgctgaaaaaactatctgaatatcttttatcaggcggtaaaagaaatgctttgctggtgatgagccagtcaacagcagaacgttcaccagtacttcagcaactgattgcggataaatctgggcagcttaaatatgatccgtgggttgtccaaagtgattttaaggccacaacggattccttacgtgaaattcagtcccaccttcgtagaaaacaatatgattcaattgtttcagttgggggagggaatatcattgattttacaaaagctgccgctatcagtatggacgaatccgttgatttagataatctgttcgctaaaagctatgacaatattcagagcaagattttccatgttgccgttcccaccactttcggaactggttctgaagtgacgaagggagccatcattcttgatacagcgtcaaagactaaagatggtgtgcgtggcgattctgttttccccgatgttgccctgattgatccggagctaggcgttaccatgccggatgctgtgctgcgcgagacactttttgacagttttacgcatgttttcgaagcactccactccgttaaatctaatcctgtaaccgagtcactcgccgtacagtcattgcaacgtattaacattaatattgaccgctatgtagcaggaaagctggacgaacacttctataccgaagcctcatacagcgccttactgggggggatttgcatctgccacaacagtacctgtctgcctcaccgctttgaacaggcattggctccgttttattcattctcccacgggcggggtttagccgcgatctatcccacatgggtaaactcgctgatggctcacggtaaagtctctcctcttctgactcaggtaagcaatggcctgaatgcatcagaatacctggcatcgatattacggaaaatcaaactggatagtgccgctcaacagctcacatccctgaagctgtccagtaagaatgtcattaagaacgtgacgggaaatatcgccaacgatccgctcgttaacgaagccgggaacggcattgttaatgcgcttctgaacgaaataaccggggaatgatcatgttttactcactgatgtgtcacgacaaacgccaccagacttatgaacctgaagtcatcgcacctgcccctgcggacttcatgcatattgaaatcctaaaagcgaccatctgtggatcggattacatggtgttgaaccagacgcatccctacaaacagtacccggcaattttgggtcatgaatttatcgggaaaatttctgatgacgcaggttcaggtgatctgaagaaagggcagtgggtgacagggctttcgtatggctcctgtggtaactgcatttactgcaaacgcgggatgaataatcactgcctgaaaaaagtcacctataacacggccggaagcagtggcgcatttacacatagcatgacggttcatcacagctctctcgcgcccttaccgccgggcagaacggcagatgattatgagtttgtgttatctgagcctttaagcattgtagtgcatgcccttgataatctggatatttctaatgatccatgcctgacagtcatcggagccggatcaatgggactgctcagcgctatcttctgccgtgaagtgaaaaatattgagaaagtggagctcatcgataagacacccgaccggtgtgcgtttgcgcactcgctaggtttctccgccagaacggacatgtcagacatgactccctcagagactgatattttggtgatcgctggtggtgaaaccctgaatgttaatgactacatcggcttactcagacctggtgcccaaatagtactgatttcctattttgatacgcccgtggtggtggacatgaatatgatagtcagaaaagaaattacgcttcagggttcttttttgagtgaccagaaagatttggcgaaagcaatacagattattgagcaatcaaaaacaagagattcccgactcaaagaaatgataaccgatttcatcactttcactgaactaagtgactttatgctgaataaaaccagcaaaggtaaagtgttgatcgataaacctggagtattatcatgaaattaaatgcttatgttattggagcaacgggatggacgggcgctgagattattcgactcctggcgcatcatcctgaaattggtgagatatatccagtttcacgggatggcggtgtctcactagacagtgttcatcccaatctgcagggaatcaataagaaaacctggtccctggattcccttcccgacagcagcccggacgtggtatttatttcactgccatcaggcaaggctcaggaagtggctgcacattttgccaagggcggagcccgcataattgatcttggtgctgattttcgcttctgttctcccgaaaattttgaaaaaatttacggcaagccacataaagcgcctgagcttcagaataagtttcagtatggctatccagaagcatttcgcgaaaacattgccaggagtcgttacgttgctaaccccggctgttacgttaacgcagcgctttgtgcactgataccgctgattaaaaataatgttttaaaaacagatggtatttttataagcgcagtgaacggaacctccggtgccgggagtaatgataaaaaagaattgctgcattataacatgacaaacaacatgcttgcttattcccttaacgggcaccgtcacacacaggaaattgagcaactcatcaaagtaataactggcagagaagcagaaatttcattaatgacttcacatggtaattttgcacgtggcatttttatgttaatcgccgcaaagcttcaagagaatattccagcagacagaggaagaatacttgaaattcttaacgaatactatgctgactatcctttcgtatcaataacaggacagcataaaggttcggttggcatagataaagattacggtatatatccacagctctccaaggtgattggatctaatgcttgccatatttcggtagacgttgtgcctgaaagaagggagctgcgcattgtaagtgtcattgacaaccttgtaaaaggtgccgccggcacagccattcaaaatatgaacatcatgatgggctttgacgaagaaacggggttgagtcgctatggaatctaaagagaaagtacttattgttgatcctgtgcataaacatcttctttcatttctggaagaaaactacgatgtcacagtaaaacatcctgttacgcaggaaaaacttatttcggtaatcgatcggtatgacatgctggtattgagaagtggggcaaaggttgattcatttttgcttgaaaaagcaacgaatgttcacacaatcataagagccggaactgggacggacaacatagatctggaaaaagtacatgaaaaaaatatccacttttacaatacacccagcacaaatgccagagcagtagcagagctcagcttcggcatgatgcactgcctgtatcggcatattttacgtgccggaaacgaaatccgtgacaatatctgggataagaaatcccttctaggttatgagctttcgaataaaaaactgggcctggttggttttggtagtattggaaaagaaatagccgatatttcagctggttatcatatgagtatacactgcacggtatccgattactcttcagagcgggcaacagagctgagcagccgaaacatcacgttgcacagtgaattaaacagtctgctggcgcattgcgatattatcgtggtctgctgtccttataatcagcaaacccgcaacctgattgacgcaagagaactctcactcctcggcaagcaggctgttttgataaacgttgcacgtggcggagtggtaaatgaatcagctttatataatgcgctaagtgaaaatacctttttaggcgcagccagtgatgtatttgaacacgagagaaaaccctccccgctttttacattaaataattttattggcacgccacacattggcgcaatgtcccatgaatctcaggaaaaaattgccgagctgattattgattatcttcagcatcagcagagcagtaacatgataaaaaaatcccgcagtcatgcattaacaaactgattttattcaacagtaacatgagaggtaatatatgagtattcagaaacgtcttgcccgtggagaatatacacagttcatggaagctcataacgggctcagcgctaaaatcgttgaacatgccggctttgaagctatatgggcatctggattgtcaataagcgccgctatggggttatcagacaggaatgaagcctcgtggtctcaggtcattaatgctcttgagcagatggcggacaataccagcatacccattctcgtcgacggcgattctggctttggtaattacctgaacgttatgcggtttgtaaaaaaactcaaacagattaatatcaatgctatgtgcattgaagataaaatgttcccaaaagtaaattcttttattggtgaaaatcaggcactcgcgcccgtgagtgagttctgcaataaaataagagcggcgaaagacaccggcggtgatgagtttaccgtagttgcgcgtatcgaagctttaatctccggacatccaatggaagaagcacttgaacgtgctgaagcttataaagatgcgggagcagatgctattttgatccattcaaaaaaatcggatgccggagaggtatttactttttctgaacgatggggcggtaaattaccactcttcgcagtcccgactaagtattacaacacagaatatcaggagtttgttaaacatggagtaaccaaccttatctgggcaaatcatctcatccgtagttcagttcgtagcatgaaagaaacggctgacagaatctacaaagagaaatcccttatcaatgttgaaaaaaatgtatcttctcttgatgaattgttttcactaaccactgaacgctatatggatgaactggaggctaaatataattcataaaatttaattgcactctctgtatcctacataatttattaacgttgtatctcattattaatcagcttaatgctgagggtaatatatattggagaaaacaatgatcaaaatagctatcgtgggcggcggcccaaatggaatgtattttttaaacggtctgcacagtatttttaaagaactgaatgtgcgcgataatgtatccgtaacaatgtatgatcgtcatggctatttcggttcaggctggcctcattctcctgctcaggctaaaacgagtatgctgaacaggattgtaggtcagctttcttttgcacctgataaaaccaataatgccagcgattcttttccaaaaagtacacgcataactttcagtgaatggctggagaaaaagtataaagctacgcacagtgaacgatataagctgaatgctgatgacttcccgactcgtgaactttatggtgagtcgcttgttgagatctgtgacgcgctggtcaatgaagtcagacaggctggagtcggcgtatcgctgattaaagatactattaagcagatcagtaaatctcagggtaaataccaactgatcggggaattttattctcagccagctgaatttgatatcgttcttctcgcgacaggccatcaggaatcaaaagataatttctatctggccggaacactcaaaaaatataccgagtactataattttgcttacccactttttgacgttcctgactggcagaagaaaagcattgctgtaattgggatgggcctgacagcgattgatacgctgctttactacacggaaaacaaaggaggtacgttctttcgcgataaagggaaactacgttatcacgcgagtggaaatgaaccgaagaaactctatgcgctgagccgctccggctattttacctacagccgcccgcataatgccaaagaggttgatctcgcaaaatatgaacatcagggatattttttcacccgttcattaatcgatcagatgcgacagaacctcggcactccggcgcacccggacagttcgccggaaaatcattctctgcagcttgatttcgacgtacacgtattccctcttctgatgctagagctccagctttgctattaccgcattctttttggtcccgaggtgctgagtatcatgattgctgagagccgccctcttgttgagcagttcattaccggtaaccgggccgtaaattcacagaaagaaagtgctcttaactggttgacgcaggctactgacaggcttgctcgtgaggtcattttccttacccgtcgttttcttaatgaaggggctacgtcatctttccacggggttccggttgaagccattgtgaaacgttacgtttatgtcattagcgcccagcagccaggaaaagagcacgatctgcagcaattttctctgtccgcactctccgggccaagcccctgggagcacaaggcagagcctgaggctcacctgtttaactgggatatggttgtcaaccctatccggaatatggattttgcaccgggtaccgcatggcgcgaacgtttgttggcattcatgcactgggatcgccgtcaatctgagcagggtaatctggacaacccctataagggtgcctgtgatgacgtgtttcgcgacttgcggcaaactgttgtttatgcagttgattttgggggtattacacccgcctcctataacaacatgctcaaggatttttatgccgtgcataaccgggctgctaacggtaactgcatagcgctgatggaaaagatggaagcgttaatcgaagccgaggttgtggatgtcacttatgcgcagtcaaatattcaggttcatgacgaacaggtttggttacacagcctgagccaggccggagaatatacccgtgttgatgccatgattgatgccaaattacacaattttagtgtccgcaaagccaaaaacagccttttccgcgatctcattgacgccggtattgccagttactgggtacataaggatacccgtggcgttgagtgtgcggcttcgggatttaatatcactcgaaatttccagtttattaaccgcgatggtaaacgcgagcgctttttctgcgtaggacagccttcagaagggatcatgttctttcagaacggttctatacgccccaatgtcaatcaccatgttgccaatgacctgcttgcatgcatgactgcggtcaaaaatgagctcaagggccttctgcacaagcaagaggaggatgccactctgacccactgacgcattatcaacagtgaaatttacggtttttcctgacaatctcattaaggcggttaatatgtatatgtatccgtttaccgggtatcagcccgatgttcccaaggtcactcatggcaaaggcatatggctttttgatgaaaatggcaaagattatattgattccacatccggacccatgaccgtgaatctgggtcactgccatcctgatattatcgaggccatggaggatcaacttaagcgacttcactttgcctaccgctttcatttccgcagtcaggaggcggagttgctggctaccaggttagttgaactttctgatgataacaaaggctatgcgttttttatgaacagcggttctgaggcttcggaagcagcgtaccgtattgcccttgattacttccgtagccggggtaataacaaaaagacgcttgcgttaggacgaagaatatccaaccacggcaataccatacagtcactgacttacggcgacgatcgcgcccgaaaagttaacctgctgaataaggtcatcgatcctgctatcagcgacttacggctaccaccttattatgacctgcacaagcctgaaggcatttcatccgatgaatggttagacatttgcctgaatgaaacctttgaaaccatagacagagtaggcgcagaacatattgcatgcgtttatgcagagcctgtcaccgcgtcttcgggtggggtgctgatcccgcatcctgactatttccgaaaacttaaagcaggcctggaggcacgggatattctgctgattgcagatgaaattgtcaccggacttggccgtacgggcgaatggttcagcatgaaaacatggaaaacagaatctgatataaccattattggcaaagggctgggagcaggtttcacccccatctcaggcgtcatgatttcaaggcagataggggatgcgctggcctccctgtctcccccccatttcgtcggacatacctattccggaaaccctttatcggcaggcgtggcacttgcggtgcttgatacgctggaaaataaaatcggaatggcgtcagtcaggtccagaggggcatattttggccgtttgctgcaggagatggttggcaaggaggacgtggtggctgaaatccgagggcagggactgctctgggctgtggagacaacgctcagccgtcagcgagcagagaagtttgtgaaagtcggtcaccaggagggcattaatctttatccgtgtcggtcatcaggtaaggatggagaagcactgacctttctgttcacgccgccactcattatttctgaaaaagagatggatgaactggtggggcgcttcagtcgtgtcatgagtcgtctggtatgaggagagcaccggtgatcctgtacagcgccggcatcaatatttcctcgggggtgcgaacgcaccccagaattaacgaagatgctgagtcgatcaaatcgctcatgaatggccaacagtccattctgatctataaccatcagggagattatttcaagaaaacagcagaacctaccccgtggattgcatctcttctgagcgaacgtttgcagcagcatgtccattatttccctgactgtgtgggccggaaggcgcaagactttattgcccgactgtcagaaggcgaagtcgcgctcatgggaaatacacgtttttatcctgaggagcaacagaacgacgcgacgtttgcagcagatctggcaaagccgggagatcgactggtgatcggcggtttttctaaattacacaggaaaaatgcgtcgaactgcgcgatcaaagctttcattccgtggtgttactcagagggggtgctgtcgcagcttgaggagcttgagcagatacattctgctctttaccgccacaggcccaccatactgctgctgggggggaataaaaaggagaagctgcagtttctcttccatcatccccggcttccttatgttgaccgcgtcattgcaggaggcgccgttctgaacagtctactcaaagcgcgtggtatccagatcgggcagtctgactgttttcccttacctgaaaatgtgtcgtttaatctgcccttatacctaccagaggtcctgatcgtctctgatgctcaaggtaggatggtgcgacgacctctactgcaggtccgtgacagagacaggatagtggattttatcttcagcgaggagtttctggcagatgtaacgggtcctgatgacatttcctttttcgctgcaggtccgctcagtgtgcccggtagtcagtatgcccatgcggcatacaggactctaaaaagaaaggggatacagggacttttcatgggaggagacacgctgacagaaacggagacattctcattcacatcatccggtggtggtgcagtgcttcacttcttctcatcgggctatgaagacatcaaatttcaggaatcgtatggaagctaattcactatcatttctaaagcctgtcattgccgttcataagcgctgcggtaaagagttagcaggaacattttttattcgcctaatctattttatcgcatggccttatatggttttggtctttcagcaagattacggactcaatacacttgacactggcctcttgcttttccttgccacactcacggcgttcttttcgacacaattagcgggaacggcaattgaccgcggtcatcttaatatcgtattccctacagccagtttgacactgatggcagggctgtctctgctgttagttcagagccttccggcagccgtcgccggcctgaaccttctggttctctctacgcgctgtctggaaacgggctttaaagtcaacctcagtaatagcgcgacacgtgaactcgccgagagtgcacacaatgcccgatattactatgtcaacgtgggtggagcattggcacctgctttggtcgctctactgggactacagggacgaacctaccttttgtacggttctctcgccatggcactcttgatagcgttatatacgttttactgccgacaagagacaagacgaaacaccaacagccccaccatgtcagcaagcctgaaacggatctttcgcgaccgttcattcatgatgttgtgtgtgttcagcgttcttttttatatggtcatggccagtaacgatactgttttactgatgttgctgagccagcagttatctcagaaaacagccttgcactactatgcaactgtgcaggtaatcaacacgctcatggtattgattgcctatttcccgcttaatcatgccttaaggcatcttacactgtcctttcgcctgaaagctgcactaggcgtgatgatagtgagccaactgatggttttttttaatctgctgaacagtgaatttaccgttgcggtttttgctctgatatttaccctgggcgaattggtcgctatctctacctccaattttgcaatggagttactcacgccctccgaattcaagggcggatatttctctttttacaacatatatatgaccggcatggctttagccccgctcctggggggcgcttttattcacgccggtatcggtgaccgctggtatctgattacagtcgcagcgctgataatcgcgtcatgcatttttagcaggattcaggtcgataacaaggcaaaaatattcaatgaagtaaagtgaggtaatgaatgcgttttttcagacttccgcagggacaggacactgcgatcatctataaaaatgagatcctgtcacgcgacagagtacgataccttacgcactgtcttgcagataaattactcaaccattggcctgtaacgctcagcagggtggcaatgctcgttgatccttcaccacgtcagcagataacggttctggcacttcatcatgccggtatcacctgtgtccctctggcaaaaagcttgccgaaaacacgtattgaagagattacccgcacgcttgcgctggaccttattattactgatctacacatcgatgatatccctggcgttaacattgatcagcttttcgaaaatctcattgataatgatgaattggttatccctgccgatgttgagcctggcgcggaatgcctgatacttcatacctcgggaagtactggtgtgccaaaagccattgcgctgagttgggataatattgccagtgtggtcaaggcttttactgaaaccccgatgttcgggtcttcatcaatggcaaatcgcatatgcagttttgacttttctgtgattgaaacgttgccttatctttaccatggcaggcttttgcacatcattgatcagtcaactcgtgatgttccccggctgctggcagaagccatcctcgactcaccggcagaagtcgtggccatgaccccctcctggttttatgaagtggggcgccagatgctcgcacttcagaatggcagctatgagcgtgtgcataaaaaaatcatttttggcggagaaaaaatcaattatgccaccctgaaaccctggtgggaggcgtttgtggctgaacaaggctgcgaggttttcaacatttatggaccaactgagtgtagcgtttttgtcacatggcatcaggtgacagacgcagataccctgtgtcctgcggctaaagtgggcgaggcatttggagataattcgctccatatcgtggatgagaataaccagaagatgacctcagacgggcagcctggccgactggtggtcgagggaaggtctgtggcactcggctatctgaacgcggcaacggatgaacgtttcagtcgtgagggcacgacacgacgctatgacacaggagacatcgtttatagggaaggtcgctcgttctttataatagggcgtggcgataatcaggtaaaagtaagaggctttcgtatcgatcttgatgaaattacccggaacatttcagcagtcgatcatatccgggatgttcatgtatcagtattaaataatgagcgtactgagcatattgtggctttcgtgacgtccactcaacccgatgttgccgaaaaggtctatgagcacctcgcaaaccatttgcctgaatatgcactgcctaatcacatctgtcaggtcgataaccttccattgaatcccaacggaaaagctgatgaacatgcactccgtaagcactatgaacaggcgctcgaagagaaaaacctgcgcctgatggccagacgtatcaaggcttacgcctttccgtcacattatacgcttggagacctgcatctcacctctttggagattgttgagctgataattgagctggaaatggcctatgggatcaggctacccacccctgataaaaaacagttgctgcatagcctggctaaagcgtgtgaaacattacccacatctgccgttgcgcagtctgatggtgcccctgaaataccgacgttcagccggacactgccatcgcagggatactactgtgacaattattttagatatcagatacgccgagatgcggtgtctgtgaccttacagttttccgagcggtattccgaggaatccctgagaaaaggcgtctggagtctgctccagggtgttccttctcttcatctgaaaatccgtgaacaggatggtgacgtctggcaatatgatgcccacatccatgacgaagtagataactatgaattgaaggattcttctacaagtctactgtcaaaggattttgattttgaagaaggcaaactgttctatttccagctcaaaagtggaagtaaaggccctcaactcacgctgcattttgcacacgtgattgcggatggttacgcatgcaggtggttgataaatgcactgctggctctacttgacggacaggcgtcacctccggtaaccccccttcatgcatatgctaaccgcgtctggcaacagcagccggatgagcaaactggtataaaacagttctgggcccagcaatctgtgcttgaaaggccgtccatgctttttgggatgattcctgccacggtttcgtcagggtgtacagaaggaatgattaaagtgcttgtgtgcgattatctacctgcttcactgctaaaccggctgctaacggatacgaatatttcgctgcatgctttggtgtcttatgcagtatggcgcgcgcatcaggcactctgcacgctggaccagctggaatttcactcaccaataggtaaccgtaatcgcgagaaccatgccgtcattgcaaatatgattacgatagtacctttcagtatcagcctgcctgctgaggaaagcctccttcgtcagttgattgcaatggaacaagccatagctgaacacatccgtttatgtcagctcagttggggggagaccgctgatttgaccgggcgcagaagaatctcgctgattgtggctgaaagccctaagctcttcagtgacagcagacacggtgttcatgaggttgatttagcagggccggtgatcgcgaaaaatgcactttcatttttctactgttcctacaaggacgcactgcatattgatatcagatataacaattcagtggctgaaggctctgttattgaaactatcagtgaaaccctgaacagggaactgcagggaatagctgacagactgtcagataacaactaatacctacatcaacatcccgaaaagtcaggagataagcgttatggcagaaaatcctatggcaaagtttcatcaatggtggacagagtacaaacgagatgtgtctcctgcccatccgggcgcagtatgtgtatcaacggtttcagaaagtggcgcgccgcgcgcccggttcgtcggtctcaaatctgctgatgaggatgggttcgtattttgcacgtggtttgattctcccaaaggtaaggatttgaaccagaacccaaaaatcgcgctaaccttttggtgggaagaaaaaggctggcaggtaagagttgaaggtacggttgaacaggtcagtgagcaggagtcaaaaaaggaatgggcttcgcggtcacgtgacgcccagcttgctaccctttgttttaaacaaagccagcctcttgattcggaagatgaactttatgatatgtaccgtcgagcacaggctgagacaactgacggacccgtagagaaaccggcgcgctggggcggctacaaagtaatacccgtatcgatagagtttttaactttccgtgaaaatcgcatgcacttacgcgaatactactaccgtaaagataaaatcaccgactgggaaaaaacacttcttcagccctgaagcttccccacgtttccttcagtcaatgccagactgtgacgtaaagaacaggcaggatggcatttttcggacatcaatttttacctggttggtcaccatacctgcgtagcattctcaagcagaagtgtgcggatgagcataggttactcgtagatcattatattaaaggtacattttagcgcctcgggccgcaaagtaatgctatcgaagagagtgatccacactgaatttatgatggcctaaggatttattgaagcggcctggtgaggctggatgggggattaagatagacagctggatttgaggggctggcttttggctctcatcaggctactgcgtggatcttttcgttgagccatttaaaaatcccctaatggcattaataatcacctctgggttaaatatacgatagaagatcgtatcagcatcatagggggaagaggccaaaaaatgtcaggttcgttgacccgtttcttagaacatcctgcggcgcttgttttacataataatagcgcgcttaagagcctctgcctgacagtgataattgaacctctgattaagatatgcacccatcctatttggaatcaggggggaagctcgctggatttcagacatcatgggatcatcccgcatccctaacaaaagttctttcctgtgttttatcagtaaatctcgccatgaatttttagaaaaagacaggctgaattgaccctgggctaattccagaatgaggatgttatcgtgcggtcgcttgtgtgtgaaggttgcttaaggacatcacaggcggtgtggtttgctgagaatgccagtcaatgatagcaggccggtttctggcaccgacggggtagcttcgcccctggcgatttatcatatatactgcgcccttagttttcgcctgtgaccacgaaaacccccgtgttgttgccgccttaacggcgtgataaatgggttttccagtgacaaacagtaaggataatgaggcgtcagtcaggactactatgagtaaaattgcaaaacaactagccgccagattgttcctttcgttgtggcaggtgacaggttatcgcgtcaaaaaaattgaccgtttttctgaacaggatgacctgaaaaatatcgctattatttcgaatacggcgcttggcgactttttgtttaacacgccagcaattggtgcgataaaaaaacgctggcctgatgccagaatcatactggttattcagccgcgaaatcatgccctggtggcagaaagtgaaatgatcgataaggtcctgtactgggatggaaaatttcccggcatgttgtcgctggcccgggccttaaggaaagatcaggtggatgccacgtttatcctgcactcccgcacgccttacgacattgtcaccgcctcactggcacgttcaaaatacatattcaaagacgtttactatgcggattaccagggcaaagaaaactttattctggccggctgtttatctgcattttatgacaacagaaagaacggcaacattcatctcattcgtcagaaaaaagacatgctcaccgcggtcggtattgatgtgccatcggacgccatgtttattcctgcgcccttcaaacgtcaacagaataccgtcccggttattggcattcatgctggcgcgtccagttccgaacggtgctggccagaagccttctattcgcagcttattgagaaattaatagccctgcatgacgatctcattattgaactcatcggggcacagggagaaaaggcgctgaatcaacggatcattgatggtatggggatatccagcgatcgcgtcatcaacgtcgcgggtaccaccaacctgattcagctggctgaaaaaatctccggttttgcgacgttagtggtgggagacacggggcctttgcatctggccgtggcggtgcaaacaccgacggtggccttgttcagtaaccagagcaccatcgatggtgcagctcctttgcaagatccgcatctccatcaggttttgcgccccgcagaagagcaggcaggattacgtgcgataagctgcaatgaggtatatgaggccgttgagcgtaatctttctgagcactaatttctcttgagtgccaggcatggtcggttcatcccgctgcctggccccatcagctttacgacgctgtctgagcccctattgttgatgcatcgtattatcgcagttatcaaccacgtcttacgtgacacataatagtatcgctggggtgatgagagtcgcgaccggggatggatatggatgcgcaaggtgcgaccataagatctttcagcacgttatcactcacttaacgtttaggctcatataccagtttatccggtcagcgctcgcagctaacggaatgtggagattggttttttaactacatctttccaggaaatattgacatctaggggagtaaaatgatgcgccggtaatactataatcgagcatgagtaaagtcctgaccgattatctaaagcctttatatctgtcatgttcactctatattgtatacccattaatcgcttaatgtcagtccacctctataaaaccaatttaccatcttgaattttttttggaaattataaagaatttattcaaataaaagtgatgtatttgcattacttttgcgctatgcaatatgactgttttgatttttcttggttataccggtatctgtatagatagtctggtggataagtaatttaggggggtacttcatgccactttcatcattgggtgtcatttttattttccatcattacaaggctttactgattttgaacaataaaaaatttaaatgatgatgtatgttggttagatgaaatgttgacggtttcgcttcttaacgtctgtaaaagacagagaggtttaaccagttatttaattcatacattaatcgcatccagagtggatggctaaactgtaataattaggaggttttttatctaaaaaattatattttaaacgactaagtaataattatttcttatgcgctatatgaactcaaagggttatatgaggttaagaaatgttgaacattgtcgttgtaaaaattttataaaataggatttattattacattaaggagcaatacatgtggtttttcagaaatgctaaaatgatcccatggagcttgaccgacaacattcctggacagactctttcgataggtgcagtagaaatcaatcctgacgttacagaagagcaaaaaaaatataaagtagcaatgcgacttgaaaacgttggatgtgatactggaataataaactggcacggaggtccatttgttagccccggatatgtattcattaactacaacggtacgcgaaatattttaacttatgggacttcggttgacaagctcgacactgtcggcgattttctggaatatcaaaaggagaatgttaaaatttaccataatctcgttaacaggggataattaatgaaaatatgtttattttgccaattaatggctatctatttaccgaggcagtcatggaaatcatggtgtatgaaaatgaagaggatcagagagataatatcgaatatgatgctttccggttaaatgctgtgctctgtccgcttacgaaaagttaatcagatgaaacctgcgcttccttgaggactgtaccttgttagaggcaccgcgtctcagtgcctcattataattctatataatataactttgtgccaaaaatacttaattcacctacgtcccaggtgtagggtgaagcatgctgtaatatttatcagcattacccctgtcatcaatcacttcatattccacgtttgccccaggattaagcggtgtggtgactggtaccgcaacataagactgtggttctaccataatatctctcagcacctctttttctactttgacgttcaggctcatataccagggcgttggattagaaatcatgatttgctggctttgtcgggtaaagcgtagcttttgtgcatcttccggttgaggcgcaccaagccctgtcggccgtataaacactttcaggcgcaaacgcagcggcagaatcactttttggtcgcccgggttatccgattttttgagcgcgggtatctggtaaatattcaaccagtacaacgtctctttacccgctcttagtttcgcccgcgaggtcagcatcagcttaagtgagcgtaattcgccaggcagcattttcaataccggcggtatggccatgaccggtgtcttacttttatccggcgaagcatgaatgtcgccatcgtccgtccagatttgcaaaacggcagggctgctctcgctattgaccaggttaatggactgcgccatttcgttagcgttgaaaacaatacgtgttttatcaatgttcacaacggccgttgcctgggctgacagcatcgccgtgaggaaaaacaggctgctactgaaagctgaccaccacttgtaactgtgcattaacggttcctgaagtgataacttgtccgggaatagcctcaagagaggcagtaaaatcgccgctgtagatctcgccgttgtctgatgacgcaagcgtggtcagatctttataggcataccacccgcgtgcattgcctgtgccggtgctggtcatatccggtaacaggttgagtgcggcaccagcgctgttataaatttttatccccacgcccgaggcggcgctgtcattgtcatcaccatagtttgtgtcgagcagccaggttaatccgccgctgctggtggtcaggccgagtgtgttggccatcgtaacggcccggggctggtttaccagaaaccccatcgcgacgttggctgatgttttggtggagttgttgatactggagatcgccccggcctcacagcgcaaattgacagaaaaaggcgcctgactactgccaccatcagccagagcgcctacactgatcaccggcagggatactacagcaggataatcctgcacctcgcaggcagcgccgcgaacgtaggtgaccgtattgaaggagctccagccaacaggccagttaaaatgccatccactatacttagtgctatggtcgtcaccgggtttcagatcatcgctttgtagtccgggacctttaaacgcgatatagccacgaggttggttgttcttatcaggataatacgcctcactattcatgaaacgctcagttccatcaattttaaacatttcgtacagcacacggctgaacgcgctggcaggaatatagattttatccccgtcagaataccagtcgctggcattaagctgtcgtgctttccagtagcgactgtaatattcccccgtagagaggttggtcattctgaccgccacgtttttggccttatcataataagcgccttcaacttcattcgtggcatatttgcccgctgtatcccaatcgccattggtggaatacatttcatagagtttatctacatcgcccgcatcgcagcggaacagaatctgattcggcgtaaaggcatcccgcatgggcgtgttgacgggatcacccaccgcactggccagtaatgtgcctgccggctgaaacaggctacctgtattgatattaattattgccggtaacggcagtttccccgtgcattcatcacaggcccctgtccataacttcgcggtatagccagcatttttagccgccgtagaaagctgactctgactggatacgaccgtacagtttgccagtaacggaagcggaatcagtccggtggcgatcaacaaaagcgttattctaagcaacacgcgttactccttattacacaagccgggaagatggatcatctgatcgttgtgctttccggtaatttgataattcaccaggcaggtttgttgaccgtcgttattccagatgactttgagcgtgccggagtcatgaggtacgcgtgcgtacagctggccgccctggccaacaacgccgatgacggtgttatccgcatcacggacttccgcgcccataggtggcgtttccccctcattactggtgagcgagatcaagactgctttgcctttgatcgtggcgaagttcacctgcaccaccgcgccagcgtaaggcacaacccgatgactccctccgcttagctcggcatcggcgttcatatccagcgtgtccaggctaatgttgttttcgcgatacgcgctcagggagggcagaatggcatagccgaagcgatcgataacggcgccctgaccattacgcacgcgtgcgccctgtgcgccatcggcctgcaccagggcgaaagtatcactgctgtaaggaccaagtgtgatgcctccccggtgaagaaccaggctgccggaagcacccagtccagcctggcgatagctttcgccctggccgtaattggcacggaacgccccaagtcgggtattctgctgaacatttccaccgacgttcagtgcatgtccactgttgccgttgcggtagtgctcgctaccgccataaagggaataggcgatatcgcggttgtcacctgctgagcccgacagggagagtgatgagctttgtgtctgcttcgactggttgtagtgataggaaacagaagcggtgttgtgccaggtcagaggcatcgaaaccgtaaatgaaaaggtattttctgtgtaacgctgctggcggctgtcatccggctgatcgaagacatttagctcggcgcgcgtcgtattccatgtggtgcgctgacgcgcgacattgaaaccgtagctaatctttttccagctattgttataaccgagctgtaactgggtgatgcgtgacttgttgttatagtagtcagccgtgctgccactcaggctgatcatgccgaggttatcaaatgactggctcagggtggcggataaccgattgcgctgattcatcgaatcggagtagtagctgatgccggtatcattctgccttctgacgcccaacacgtcctgcagatcgcggaagccgctggtggaataacggtaggccgccaacaccagattagtgccagtttcaaacgttttgctgtaactcaactccgcgcgccagcccgaggtgtttttattttgctcaacgcgcgcctgtgaaaaaatggtgttcatccccacggcacccatcggtgaaccccatacgccgccagccagccaggcctggtagtccttcgccagccgcgagccgatcgttgccgtaaaacggttactgatgccgcgctgtaaaaccccctcaaaaaacgtgttttccacgctgtaatattgtcgcactcgccccagcgccagcgcgtatttccagtttcctggacgaacagagtccggcacggacgagtagggcactgtaaaagtggaccgcttgccgttggcttcaataatctcaacgtcaagatcgccctgaccgctggtgttatataagtcatcaataacaaaggggccggggggaacgctggtttcgtaaatcacgttgttgagctgccgaacgacaacgcgggcatcagaggtggctacaccatggacttccggcgcatagccccgtttaccctgcggccacatccgttcttctgaggcgagtttaatgccgttaaaggcaagactgccgaacagcgagttgttggtataattgtcacctaatgagagctgactgtttatgctctccacaggacgctgcacccagcttctcacctgattatactgataacggcttccgctatgactgttgcgcagatagcgcatattgccctgatgacgaaactgccacttgtccagattcgtgcctgcggtaatgccgctccacaaatattgataacgataatcagacgatcggttttccgaccaggtgaagttagtgttgtgacgcagaaataacgctgtaatgccttcatcccattcagaaacggggatatagccacggggaacccggttcaggctggccagaggaaacatatactgcaaacgaagtgaagcctggtcgaaacgccagctgcctgcttccgtccagtctgataatggctgacagtgggctgtcgtttgttccatccgctggttttttaactgcattaacctgatgatctcttccggcaggcaaggttccacctctccctcgtcactgaattttttgaagttaattttgacgccggatttaattattttatcgttgaggtaaatatcaacaagataacttccttcaggaattgcattttggttgaattgttcaatgtttttcccaaatgtcgcccctttaaacagtgaggcgtcgaaataataatcttcactgcaggcataacacgaaaaacaggccgagacggtaaaagcaataagtttcgggctaattaacgtcaaccgtaaagttttcactgattttagctccctgatcgttaactgccgagactgaaactacgcctgcaccctgcaaacgtttgctgttgttaaaccaataggtttgctttgcaaagggcgagaccatatcggcctcacttttaaaggtgtgattccccacttttaaaacaacatccaccagggaagcatgccagggttgtgggttgtcaatttcaatcccattgcctttattcgcctgatacaggggagtgactgttatgcctttcaggatgttttttggtgcgccaatacgctcagggcgataaaaaaccttcatgcgattacgcaataccaccaacatgacattctgtgtcttatcctgatttatatttgatggcggaatttgcagggtattaaaccagtaaacagattcacgatcctgaggctgtgcaacggtgttattcaccataaccttcgcgatctgacctgccttcggctgaatgcggaataccggcggtgtaatgataaaaggcgtatttacgcgattttctggctgtgagttttcgtcaccgttatcaaaccagctctgaataacatagggaatggcatcgttatttttaaattgcacatccatagaacgcgcctgcccagggtaaataatacggctgcccataatcgtcacgctggcgtttgcgtaaaagggcaatgttaatgcgggggttactgctagcgagagcgtcaacgccaataacagtctgcgaataaacataaatcagttctcaatagtttatggtgcacgccagacaactgacgtgcaccggatcagtattactggtaagtcaccgcatattgaagtgaagcactaacggtacccgccgttgctacgtcggtcgccagatactgcgcggcataggtagccgatttttcggtttcgccggagctcagggttaaatcaccatcaccgatataggtactggttaaattaatctctgcaccggtggggtccagtaactgaatttcgacgttttcagcattaccactgtttttcagattaccgttgtcgctcacgttgttaccaataaatacggtggacacgcgcgttgaattagtcgagccggtacagccactgatagcgacggagaagtccgttttgcccgcgacttttccgcttgcatccagttcgttcacgcccactgtcggcatcaacaccagcggtgcactgttattaccattcacgttgactgagcaagtttcatcgctcacttcaccctgaaagttaatggtgttatcagaattcgcgaatgcttgtcctgataccagcgtcgcactgattaacagggataaggccatagctttggtttttaacatgaggtattttccttttacatttttaactggagaacaactgattcaggctgcttcccgtcttcctacgaaccgaatctttgatgcagtaaatttttttaacgctaagctccattttttttgatatttcactcagagaaaatccgtgattgaccagatcaagaaacttaacctcatcagtggttaacggattaatcccttttttttcacctccttttaaaccgtagtaacatgcgttaattgattttttaatatcgacgatggctgttcctgggtaaatgaccgtattaatacttttatcctgttttttccagaaagcagctaaggatgccagtctgcggtcgcaaaccaggatgataattaaactctgtgatttcaaataatccagccagttatgactggtaaaaaagcgtatgttgtgtgttgaaaaatccacaaatatacaaccttttgtaaataagctttcatatcgaccagaaacgacggaaagaatgccattaattaagtagtagttccgcgctggccaaataaccactttttgtatcgggcaccgtttaatttcttctgttagctcattggctaattcacaccggtagcgacaactaaagcaatatatactttctctcgtaatccttctcataagcttgttttgctgctcgttaaggaaggtgagataaacatagcattattaaaccttctaattcaacgcgttgggcgattgcatggcgcaatggacatggaataatcctaaagtgtcatgtttcatttatttttaacgcaaaaaggaaatttatcccacaacagtgccatttattgtgaacttaaaaagacagtatactttttatgaattcagataatttcatcctccccaggatttttctattaatattaaggatgcgatcaataaaattatcgcactttaagataaaaacggtccattgattaaatttttgtaaaaacaacatatcaataacaggtggcgttaatgtgttgttaattcctgtgaggctaaagatgaattatgatcataatattaatggtatattttaagtatgatagcaatatgttgcttgcttaatttttacgcaatgatgcacgagatagtcaacgcgatttgatctttgtgtgttcacttacaattcaatgaaatttatttaatctttttgacaatgttgtcatttatcgagatgttatttgatcgctaaatgtaagagctaaacgccatttttttcaggttaacaacaataagttatcaattttgatggaggtcgaacgagggaataacataataagacgcacttacccagcagctttgtaactattgttataattgctcggctaaaatgttatagctgtgcatctgcctctgataagggatgttctgataaccgctgtctatcacaatcaacaatgataacaatttgctacccggttccatcagggtaattatggaggtatgacgacatatcgcattaaagtgggttaccacaacccttcagcactgacgttcatgcaactggatgagcagcttgctgaccacgcgttttacagcgcacgcgccgacgcggacagcggcggcttccgctattttcaggagtatgaataccagtccgattctgccgattattgttcggtgtgctccatggcttaccatcacgcctgtaaggtcagaaaatgcccgctggtgctggttgaaataaaagaagatcaccccggctgacagcgtcagcgcgcggtttctggcagcgacctgtgcaatatccctgtactccctcggtacttaaatcatccgtgctggcctacactgacaacgtacattttaaggggtaagccatgtcatctactgaacacattatgtctgactgctgtattgtcggcggcggcccggccggtctgatgctgggttatttactggcgcgtgccggtttgcaggttgtggtgatcgagaagcatgccgactttctccgcgacttccgtggtgacactattcacccttccacccttgaggtgatgcaccatctgggtctgctggatgacctgctgaaactgcctcaccagcgcgcagaaaagctgcaggcggaaatgggcggccaggaggtgacgatggccgatttttcgcgtctgccgctccagtgtcgttttatcgcattcatgccacagtgggatttcctgaatttcatggcggaacgcagcgcacagtttcccggctttaccctgttgaaatccacaaccttaaaccagctgctaacagaagagggtgaggtaagcggtgttgtcgcgtcacaggcaggccagccggttgagatccgtacccgtctggtgattggtgctgacggtcgtaactctaacgtacgtgcacaggccggcctggtgagtcagcattttggctcgccgcgtgatgtggtgtggtttcgtctggacaaaaagtctgacgatccccagtcaggcatgggccataccgggccgcgcaacaactttatcgtcatcgacaggggcgattactggcagtgcgggctaaccatcgagaaagggcagtttgatgcgctccaggccgaggggcttgaggcgatgaaacacaagattgccagcgcgtctcccttttgtcctgcgcgcctggcggaaattgacaactgggatcaattcaaactgctgtctatccggatcgacaggctcaaccagtgggcgaagccgggcgtgctctgtattggtgatgcggctcatgccatgtctccgattggtggcgttggcgttaatcttgctatccaggatgccgttgccacggcgaacctgctgaccctgccgttgttaaagggaaagatcacgttaagggatctggaaaaagtgcagaagcgtcgccagtttcccaccgttgcaacgcagttcctgcaaatcaaaatgagcagtaaaaagaaaccgggcagtgagggcaaaagtaaaatgcctgacatcatccgtaagtatccctttctgcgctttatttttggccgactcatcgggatgggattccgtatggaaaagccacgcagatttcacaactgaaggtgtgttgattctgggatgcggcgctgtcgtggatgacggcgctttaccgcacccggtgtttcctttgagcctgacaagtcccgccatcagcctgaagccaggcgtgggctgggctttatgtttaaggttcactgtttacggcttactgtcacccacaacctaaaacctacaacccacaacccacaacccacaacccacaacccacaacccacaacccacaacccacaacccacaacccacaacccacaacccacaacccacaacccacaacccacaacccacagcccacagctcacagcccacagcccacagcccacagctcacagcccacagcccacagctcacagcccacagcccacagcccacaacctactgcttaccactcatcgcccatcgttttagcgtttatactgctaatcgcaccatactcacggataaccgctttggcccgcgcgccgcttgcgtcctgatgcaacaaagcccgttgacgtaatcagccgtcatgtttcgcctcaccgagaggacgtctttaacagcgtataaggtcgccaacggcaggaaagatagtgcgatgtagctcaaaatttcagctaaaggtattataaaggttatgtacgtggtgttagattggccttaccaacaccagggaacacactataatgaaaacgaaaacggccagcctgtcatttatgatgtttgtggaatggtttatctggggcgcgtggtttgtcccgctctgggcctttctcagcaaaaatggtttcacgcccgtcgaaattgcgtggtgctatgcctgtacctcccttgccgccatcctgtcaccgattctggtgggctccctggcagaccgtttctttcaggcgcagaaggtgctgggcgtgctgatgatcgtgggcgccgggctgatgtatttcgcggcgcagcaaacgcacttcagtggtttctttcccctgttgctgctttatgcgctgacctatatgcccaccattgcgctcaccaacagtattgcgttttcacacgtggcagatgtcgagcgcgattatccacgcatccgcgtactgggtacgcttggctggatcgcatccggtatcgtctgtggttttctgccgtcactactgggctttggcgatatctccgccagtaatattcctttgctgatcaccgccgccagctcactactgttgggcctgttcgcctttatgcttcccgccacccagcctaaaagcacgggcaagtttagtctgcgaacggcgttggggctggatgccctgcatctgctgaaagatcgcagcttcctcgtcttttttgtctgttccttcctgttcagcatgccactggcattttattacatctttgcggaaggatatctgaccgaggtcggcctggcccatgccaccggctggatgacgctggggcagatgtccgaaattctgtttttactggcgctgccgttttttatcaaacgctttgggatcggaaacgtgctgctgttgggcctggtaacggccgcgttgcgctatctgttttttgtcttcggcagcgaccagaacctgctcacctatggcctgttatttatgggcatcctgctgcacggtgtcagctatgacttctactttattaccgcctacatctacgtcgataaaaaatccccggtcagcatgcgtaatgcagcgcagggattaattaccctggcctgtcaggggataggcagcctgctgggctatcgtctgggcggttacctgatgcaggagatgtttgcctatagtcagccgcgcaacggcctgacgttcaactgggcagggatgtggctgtttggttgcgtgatgatcgttttaattaccgtggcgtttattctgctgttccgcgatgccaaaaagcgcagcgatgagctcaacgtggtggagcctgccgccgtgacggaaagccaaaaataaggaagaaaaaatgattaccccacaacaacggattaccggcgcgttttatggtcaggcacttggcgatgccatgggcatgccgtcagagctgtggccgcgtagccgcgtgaaacagcactttggctggatagatcgctttttgcccggcccggcggagaacaacgccgcctgctattttggccgcgccgaattcaccgacgatacctccatggcgctggcgctggcagatgccatcattagccacgatggcgagatcgtcgctgaaacgattgggatgaatatcctgcgctgggcggaagggtttgatgcttttaataaaaatgtgttgggaccaacctcaaaaattgccctgcgtgccttacaggccggtcagccgattagcgcgctggaaaataacggcctgacgaatggtgcggccatgcgcatttctccgctgggctgcctgttgcccgcgcgtgatttagcgggttttattgatgcggtcgcgctggcatccagccctacgcacaaggccgatgtggcgattgccggggcgaccgtgattgcctgggctgtttcacgtgccgtggagggcgcaggctgggggcaaatacgcgacgcactgcccgccgttgcccgggcggcgcaggaacgacagataaccacctttagtgcgtcgatggccgcgcgtctggaactggcgttttcggtggttgagcagggacgcggtattgaatccactatggcgcaaatctatgcgctggtgggaacgggcaccagcaccatcgagtcggtgcccgccgccattgccatggttgagctggcaaagaccgatcccaatcgctgtgccattctttgcgcgaaccttggcggagatacggacaccattggtgcaatggccgttgccatctgtggcgcgcttaacggtatcgacgctatcgatcccgcgttgaggcagcagctggacagcgtcaatcaactggactttgaagcgtacagccgtgcgtttactgcttttcgccagaagcgggaggcggcatatgcttgatccgcgcagcgtagcgacattacataataaggccgcaatctgtgtactgggcgcggctgtcgtggatgttatcgcgcgcaccgaacagcttccccagcgcggcggtgacagcgagcttcagcagcaaagcctgagcgtgggtggctgcgcgctaaacgtggcgctggccctgcatcggctggggctggatgccgtaaacgcgttaccgctgggccagggcatctgggccgatcaggtgcggaaaaaactggcgtcctgtggcctgacgagcgtcacggaaacccgtaagggcgacaacggttggtgcctggcgctggtcgaacccgacggtgagcggacgtttctgtcgatggccggggtggaaaaccagtgggatgaggcgatgctggcgtctgtccccctgcaaagggacggctggctgtatgtgtcgggttatcaactcagcggtaaaaatgcagaaatcctggtgccgtggctggaggaagtggcgaacaggcaacggctgctgatcgattttggcccgcgtctgccgcatatcagccagcatcactggcagcggctgatggcgctgcagcccgtgattacccttaaccgacaggaagcggaacacgtctggcaccagcgtttggcgatacctgagcgttttagtgcgcaggcgttgatcgcccggtggtctgactatttttccagcccgctggtggtgcggctggacagtgaaggtgccgggttcagccatcacggacagcatggctggcgagcggcattcaaaacaacagtggtcgattccatcggtgccggcgacagccatagcgcgggcttactggccgcgctggcatctgactggccacttgaaaacgccgtggcgctgggcaacgcggtcgcatcctttgtggtgtcgcagcgtggcggcgacagcgcccccgatcgggcagccctgatccaccactggcagcagtgccttactcggcaataaacacgtacatatcactgcggcagtagctgatgctgtattccagtgggcgctcatgtgcatccagcgccagctgcttaatcaccagtaccgggatcagctcgggcagggcaatcaggcgctgtaattcagcatcgggcatctgcgcgctgacgcggctttgcgtttttaccggctgaatctggtggcggcgaaagtagtcgtacagcgaaatgccgatgtcgctggcatcgttgattaattcgcacggcacccaggaggtttccaccgacacagcctgctgatcgacataacgcagccgcttcagcaaatacacctcgctgcccggcggcaactgcaacttttgtgcgatcgcatgttcacagcggatgcgatgcttttgcagccattccgtgtcgggctttttaccgcgcaagaccacctgttgtgaaaacccttgtggctctttcagcgagtattccagtgcgctacaaatctgcgtgccatagccacgcgagcggtgaacgatcccttcctgagcaagcgcatccatcgccttacgcaccgtgatgcgtgaaatacccagttgttgagaaaattcgcgttcgctgggcagcacctcttcattacgcagcaatccgtcgcgcacggcatctttaatgacctgcgtaaaacgtttatagagcggagtattgctctcggcgctgagcacgcggctcaggtggctgaaaagggcgtgatgttgtgatgtcattattctcgtctgggatacataaccttatctgctggaattctatactatctctcttatcaccgtactggttttgcagacggcaacgtgaggagagtcaaatggaaaccgcttcaccccaggtaaagcaacaccgacgcgcactggttgcgggttcggtgggcaactttattgaatggtatgagttcgccatttatggctttctcgccacgctgattgcccaaaacttttttcagttacagggcgagtcggcgctgagcgggctgattctgacctgggcctcatttgcggtcgcgtttttctttcggccactgggcgcgctggtgtttggtcgaattggcgaccggatcggacgtaaacccacgctgattatggtgctggtattgatgacgctggcgaccgcggccatcggcctcgtgcccacctatgcctcggtgggcattgcggcaccgctgatgctgaccgggctgcgcatcctgcaggggctttttgccgggggcgaatacggcggcgcggtgtctctgatgaccgagtttgcgccgcgcggcaagcgcggcctgtatggcgcatggcagtcgctgaccgtcgcactcggcctgctggcagggatcgggctggtggcgctgctgtcgtatacgctcagtccgccagccatgctggcctggggctggcggattccctttatcctggcgttgccgctggggatggtcacgctctggttgcggctggctatggacgaaacaccgggctttgtgcgccagcaacagcagcaggtcattcacgcggaccggggacaaacattaaaaagcattctgctggcgattgcgcgcgtgatgctgtggtcagcggcgggttatacctgcctggtaattatgccaacctatctgcagtccgcgctgcacaccgggcagcatcaggcgttgctgattgccgtgatctctaatctgggattcgcggtcaccattattccggcgggcatgctgagtgacagagtggggcgacgtcgggtgatggtggtggccagtttgctgttactggtattagcgatgccgctgctgaaagtgctgcaggcggaaacggccacgctatacagcaaagcgctggtggtatttatggctggcggtgtggtgggcttgctggcagggccggggccggcgatgctggctgaaatgtttcctacgcgggtgcgttataccggactggggctggcgtattcactctcgaatgccgttttttcaggctgtgccgggctgattattaccgggttgattaagcagacgggaaatctggatattccggcgtggtatatgatggcgaccgcgctggtctctataccggcactgatgacgttaaataaagacgatcatctgcgggatctggcgtgagggtaaaacgggagcaagcgctcccgtttttgatacttatttgcggctcagcaggaagccaagcaccacgccaacaccggcggccacggccagacccgcaaacgggttagactgtacctgatctttgatgcaatcagcggcatcacgagcggcgtaggatgcctggttggtgtagcggcgagctgcaccacgggcacgatgacgcggggagtcggtaacctcaccccattgttgctctgcggcaccggcgacttcttttactgcatcttcaatttttcctgacatgcttcatctccttggttatcacagtcatttaaagcgtagcaaacctttgccgtcgtgctgctccagggcgcattaatcttctgttgagtgcgcgatgaccagatgaaaacaccggtcgcaaggggccttttttaccccacaaggcgctcaggcaggggcgtgaagcggggaaacgcgatgacgaacaccgcgcgaatgggggcggagaaaaatcattaccagctgtttcattccacgagacgatggggggacgcgatgtgtttaggataccagctcaccagaaagtgacggagatggtcaaagcaccattccgcatcatcagactgcgggcagtaatactgaatagtgattttttcgaagcggcgctggcgttgctgcagcggtgaccagccccagtcaagcacggatcgggcatagttaaccagagcatcgtctgccagcgcatgctgttgcgcctgttctttcagataggcataaaacgcggcttccagctgcagcgcctcatcatgggaatggccaggcaattcgggacgaaaggcaacatcgataaaaccgcacacggcgttttcctgctgctgccagtcgcaggccagcgtcataaataacccgtcctgaagattcacctcttcgaccaggcgctgcaggttagcggaatgacgaagcacaagaatttcttccaggcgttccgtctccagcgttaaatcgatgccgcacgggttcagggtgccatcttcattgcgggtcgcagggaaggggaaatcgatatagccgttgttatccagacgcttttccatgtgaaggatgacctgtcgcttgacgtttcctgacactatatcatcccgtgacaggaatcacccctttacgggcaggtccaggtgatcagggtgtcctgatagggattgatcaaccggaactgtttatccgacagacgttgcgcgtagtaaccttcgcgcgtcacggcggaaggaatgtactgaaagcgatcctgcgactgcagcgggccgctctgcacgctggcgccgtcacgactgacgcgaaaggatgtcaccagatcgaaaatagtgccctgggtctggcccagcgactgcccgtaaagggtactgacttcacccggacagtccacgcctttcggcgacgatgagcagcccgtgagcagtgccataaaaatgaaaaccagcgatcgcaacatatcctgttcctgcccgagtccatgaaagcggtgaacgattctatcgtgtaacgccacaaataacatgatcatagcagttctgctacacaggctgatttgcgctttgttcaatcgttaagcaacagaaatgcaaaagatgactttgaggtcgaataaacgttattcttgccatctttgcgtatcgcttaagcaaattcagggataaatgatgaaagaagaagaagccagcctgatgattattcgccacgccatcgaagcactggatgcagaaaaaaggcagcaggtgattgcctgtgcatctgacattcgcgacgtcatgagcagcttcgacagcgaagaggccggtctggcgttgatgctggtcgcggctgaagttgcggcagaatagggcattggtggcctgacagctaccctgccgccggttccgtttttcgttgttgcaaagcgcatctgaacgcatagccatccgctatgccccatccactgcggtaatctttccgctctttcttcgcctggctttgtctgtggtaaactcctctgacagtgtggaatcacctattcagcggaggaatcagatgaaagcagcccgtcttgccctgtgcctgttggcctgttacagcgcgtcagcgtggagcgaaagcgaattccagcttcattgtcccggacgacccaccatgaccatttcacgggcggaatatggcctgagtaccctttcctggcctcaacagcatttccagattgcggcggggcagttgcacacccgtattaatgggggcgataatgttgccattacgcgctttcgcaacggcgaccagcttatcgtcaacaaaagcaacctcgatactttcttcgtttaccatgacagcgacaagctggtgccatgcagccgcagcgcgatgcgtgacgtggacgccctgagcctggaacgttatgacgacaggcagcgtaacgactcttgatccgccgcgataaggaaggccaatgcagattaccgttactgacaaggtgaccagtaaagatctggatgaactccggctgggcctgaatgcccataacagcaagttttatgatgcggcgttaattcaaccgctggggctgtttatctgtgatccgcaggggaagaagctggcaggactgaccggtactacgaccggtaactggctacgtatcgatttactctgggtcagtcatacacttcgtgggcagggcaccggcagccgtctggtgctggcggccgagcaggaagcgcgccagcgaggatgtcgttttgcccaggtggataccggcagttttcaggcgcggccgttttatgaaaagttgggttacggcgtccgtttaacgctcgaccagtatatccgtcatcatcagcgtcactatctgaccaaagtcctgtaattacagcagcacctgctggcgcagatccagcggttgcaattctgcctcatcgatagcagccagccagccgggcagggtcactttctgccaggacaggtgaccgcgtgtggtgctcatcagcaccacatccgggcgcagggtgcggtaaagctccagcgaagcggctaattcggcaggattactctcgggcaccagcacagtgacccagcggtcatgatgacgcgtcagcgtatcgccaacaaataagtaagtcagaccgccaggtgaatggtaaaggtagctgcaactgcccggcgtatgaccgggcgtcggcaacagatgaaaatcaccgaaatgggtttcctgctgggtaaaggtgtcgtccggctccacaaaacggctaatctgccccagtgagcggctgtgacaatagagcgcgctgttaaagcgttgctgaatgcgcgccgcaccgggcgcggattcgtgccagtgggtcagataatgccgaatcacaccgttatcatcggccagcacctcatgatccagcgggttttcaacccggccaatcagtaaattgccgcgcggatgacgcagtaaaaaaccatgcatcattatgtcttcggtatcttcttccgggaattccggcgttgagatccacaaatcgtcatacagcggcttcaatgtcgatctcctgcaacttcagctatgtgtgcaatacgggatgtccgcttgcctgtaacgccacctgaccctgattcacctgcaacgttgccgtggcacccaaaggtaacgtgacggtatccggaccgtgaccgaagtccagatcgctgatgaccggcagaccgctaatgtcacgaatgcgctgccagaccgtggaaaaatcaaatccgttgtcgtactcagacagggcggtgctggtgaaactgccggtaataatcgcctgctgccgggccagaatgccgcactgctgtaactgaagcagcatgcgttcaatgcggaacggatgctcgttaacatcttcaattaccagaatgccgttctcaatctgcggcatccacggcgtgccaatcaatgagctgatcatcgccagattcccgccccacagcgtcccctgccagcgaccctgatcgggcgtcgtgctctgccaggccaccttgactgtaggtgatgtcagcgcatgccaaaagtgctgcagcgtaaattcggataaaacctcagcgccaaaattgcccgccagcatcggtccactgaagctgatgacgccagcatgttgcagcagggctaactggagtacggtgaaatcgctgtgcccacagagcgccagcggctggtgcgcaaaacggcgcttcaggcccgcatagtccaccgacggcagcaggcgggtcgcgccatagccgccgcgcaccgccagcacaatatcgggtaaggtcgctaaatcagccagttcattaatatcgcccagtcgctcatcgtcggtgccggcaaagcgctgaaaacgacgcgcgataacggcgtcattgtcgacgcgatgtccttccgcacgcaggcgttccaccccgagcagggcagcgggctgattatgacaatagcctgaaggggcaataagacggatagaacgtgacgtcatagtaaattcctgaaattagtcagtgacagacatcacgataatggcgaaaaaccgcaaatatgtcatcagactgctgtaattaggataaacggtaattttgcaattctgccggctcggtatgatagcttccgccacttctgcgacgagataaaaaattgcttaaaattcgctactttgtcatttcagccatgctgctgacgggctgtgccagtgaaccgccgcatacctacgttaaagagaagaatacgccgttaactcaggccgcgccttcacgcatcagcggaacctggtcactctttaccgaaacggccgccaaccagtatggtgtggacgaaaaactgatcagcgccattattaatgtggagtccggtggaaaccccggcgtagtcagtcgttccaatgcggtgggattaatgcagatcaaagcatcgaccgcaggccgggaagtgtaccgcacccagggccgtcacggtcagccgagcaacgcagagctgcgcgatccggccagaaatattgatattggtactgcctacatcaaaattctgcagcagtcggcgctttcagggattcgcgatcctctcacgctgcgttacgccaccatcgtttcctatgctaacggcgccggtgccttactgcgcaccttctccagcaatcgtgaccgggcaatcgccatgattaattctatgacgccggacgagttttatcagcacgtgcaaaataaacatcctgccgcccaggcaccccgttacttgtggaaagtcactacggcttaccgcgcaaacagctgatcccgtgttttctcctcaccttcctttccggcaggtgaggagagaaccgttaagctgtcagcagccttgcggtagggtaatccacgataagcacattcacatagccgccacgcagcgccccgcgaatcgcctgcgccttctctttaccgcccgccagcgccacaacctgcgcacactgtcggacctgttccagttccataccaattaccggatcttcatcggcatccagtacaggctgaccttgctcatcgaagtagtggagacaaatatcgccgactgccccgcgcccggccaaagtacgtaacatggtcgcatcgtaatagttacccgaattacgcagcagcgcagagggttcaagatcgccaatcccgacaatggctaaatccacctcattaaatttattcagcacctcggcgacgtccgcattggcggccagtcgctggcggtctgtcactgagtgctcaatcgactgagagggcagcagccaggccgggcaattcagcagtgcagcaaggttttgcgtcagtatcgtggcctgcacgtttccgttggcacccacgccgcccagcaactgaatcacgcctttacatgaggtattaaggggatgcaaggcgtccaccatacagcgaatggtgccgctccatgaggagatgccaatgagttcatccgcgcgcacccgggtttccagatagtgggccgccgccgaaccaatcgcctgtttgatctctccggcggaggcgtgttcaggcacgtccaccacgatggcctgcggcagttgataacgttgctccagggctttttccagttccggaaagacattggcggggggaacgacgctgattttaaccacgccttctttcacgctgcggttcaggatgcgcgacacaaacgattgagacagcttgagtaactgtgcaatgtcggactgcttcttgccttcgacatagtaaagcgtggcaatttttaccatgagccgctgttcatcctgtttcgccatcagtttttcctctcgtgtcctggccgtcattgttaaccactcgcgtgaaaatcacaatccacggcaatttgtgatccttttcgctttttatcacttcatccgtagacgtgactgaccgcaaagcgcatagtggcaatgaatataaaatcattattgaatatatattcataaagggaaaggatattcacctgacagctccgatcgcgctgatcggtgcatgtgttcgctgtcagcgatgggcgttttgcgcccagtctgaatatatattcggtgtcgacttaaaattcaaaaggtgagatatgaatccttttacgctttcagtagatgagcttgaaaaacgggcgcggtcagtgcgccgtcgcattattcagcttaatgccggcagcccggcaggcggccataccggggccgacctgtcgcaggtggagatcctgaccgcgctctacttccgcatccttaactgcgcaccagaccgtatgaaagatgacgagcgtgatatctacattcagtcaaaagggcacgcggtaggcgggtattactgcgtgctggcggaggccggttattttccactggactggctggcaacctatcaacaggcgaattcggctttaccggggcatccggtgcggcaaaaaacgcccggcgtggagctcaacaccggtgcgctgggacatggattgcccgtggctgtgggcattgcgctggcggcgaagaagagcaacagtcggcggcgtatttttgtcgtcaccggcgacggcgagctggcagaaggcagtaactgggaagccgcgctggtcgctgcccattacgggctggataacctgattgtgattaacgacaaaaacaagctacagctggcgggatcgacacgtgacattatgaataccgacccgctggcagagaaatggcgcgcctttggcctggcggtcagtgaatgcaacggcaatgacatggcgtcggtggtcagcgccctggaacaaccagcggtaaatggcaagccgcaggtgattatcgcgcacacggaaaaaggttttggcatctcctttattcagggcaaagctgaatggcaccaccgggtgcccaagggggaagaaatcgaccgggcactggaggagttaaacgatgagtaatgcacaacatctggctgaggtgatggtagaggcactgatggcggccgttgaacgcggtatcgatgtggttcctgtggtggctgactccacctcaacggccaaaattgcgccgttcatcaaggcctttcccggccggttagtcaacgtaggtatcgccgagcaggcgctggtgggcacggctgccggtctggcgctgggcggaaaagtggccgtgacctgcaacgccgcgccgtttctgatctcgcgcgccaacgaacaggtgaagatcgacgtctgttataacaataccaacgtcaagctgtttgggctgaatgcggggaccagctatggcccacttgccagcacgcaccacagtattgacgatatcgccatcctgcgcgggtttggcaatattgaaatttacgcgccttcctgtccggtggagtgccgccaaatcatcgactatgcccttgatcacgtcgggccggtttacatccggctggatggaaaagcattgccgcagctccacgctgaggattaccgctttgaacccggcaagatcgatgtgctgcgcgaaggccatgacatcgcccttgttgccatgggctcgacggtacacgaagccgttaccgcagcagagcaactgaaaacgcagggcgtttccgccgcggtgatcgccgtgccttccattcgtccctgtgatactcagcagttacataatctgctgagccactaccgtgcggtgattacggttgaagagcataacgtgaatggcggcgtgggcagcctggttgcagaggtactggctgaaaatggtttagcggtcaggctgctgcgcctgggcattgccgatggggagtacgccatagcgggcgatcgcgcctcaacccgggcctgtcatggcattgacgccagcagcgtagcggcccaggcgttgcgcctctgcacaggaggctgacgatgcatgagccggtgattcttgctatcgatgaaggcactaccaacgctaaagcggtggcggtggatcggcagggaaaggtggtggcgcggggcagtcagggcctgacgctgctgcacccgcagcccggcctggccgagcaggacccgatggctatctggcaggcggtcaggcaggcgataaccgactgcctggcccagtgcgccggatcgccggtggcggcgatcgccctcagtaatcagcgcgaatccgttttgatctggcagcgccgcgacggcgtgccgttaaccccgctggtaagctggcaggaccgacgttcggaagcgttttgccgcgatcttcatctgtcaggccgcgccgcgacgattaccgccttgaccggactggcggtcgatcccatgtttcctgccgccaagctgaccggtatgctggtgtccttgcctgatggcttcgccagagcagcggcgggcgaattatgcattggcacagtggacagctggctgacctggcaactgacggcaggagaaagcttcgtcaccgaccatgcgaatgcggcacgcacgcagctttacagtctgcatagtaacgactgggatgatgaactgttgtccctgttcagtctgccgcgcgccgcgctgccacagattagcgcgtcagccggtcatgcaggcgtcgtcgccttaaccgatatggccggtctgacgccaggcaccccaattctggcacgtattggcgactcccacgcggcgctctatgcccagcggcgtggcgaggccgaagtggtcaaggcaacctatggcaccggctcctcgctcatgatgtcaatggcaacgccaatcctgaccgacaatggcctcagcactaccgtggcgtggcacgacgggcaaccgcgctttgcgtttgaaggcaatattacccacaccggctcaggcgcggcctggctgggaaaaatgctgggtgtgacggacccacagcagttaacggcgttggccgaaagctgtgatgataatcagggctgctattttgtcccggcactgtccggactgggcgcgccctggtgggatttaaaagcccgcggtatgctctgtggcctcaccgatgcggcgaccccggcagtgctggcgcgggtggcgctggagtcgattacctggcaaattgccgatgtctttttcgccatggaaaaggcgagcggtgagccgctgcctgcgctgtgcgtcgacggcagtgcgacacaaaaccgctggctgatgcagtttcaggctgacgttctgcagcgtccgctgcattgcgcgcccaccgctgaagcgtcggcgctgggggcggcactgctggcaggtaaacagctgggatggtggcagcagggcggtgatatgcaggcattacagggcggtaacgtcgtgatgccgcgcccgcagctggcgcagaaaatgcaggacagctatcagggctggcttcaggccgtcgcccgctgtcgctatcagcctgggtaagggcggaggatcggacagcgtgccgcgatcctccgttcgtcccggcgcttaacgattcgcgcggcgtagctgggccgcgtcatcatcgggaaccggcttgagatcgaccggcggcaaactgcccccgctgaattcgacctgacggatagggaaggcaaagcgcacattgcgttcttcgagtgccgccatcagctgcaggttgatttcctgctgaatatccatgtactggttatagtcggcactcaacacaaaatagaccacttcgaacgtcagctttgaatcatcaaacgccagaaaatgcgcgcggtcgaagcgcgtcatctcaatgccctgaatgatggttttcaccagctcgctgatctcgcgcacctgctcagaagaggtggcatagctgataccaaacttaaacacgatgcggcgttgctgcatgcgcttgtagttatggatcgtttgctgcagaagaatggtatttgaacagacaatctgttcgccgctcaggctgcgcagtcgcgtggttttcaggccaatatgttcaattgtcccggcgatgtcgccaaacacaataaaatcaccgtgttcaaaaggcttgtcgaaaccaatcgccagcgaggcaaacacgtcactcagtaccgtctgaatcgccagggcaatagcaataccgcccacgcccagactggcaaccagcgccgtaatgtcgatgcccatgttcgacaaaatggccaacagcatcatcacccacaccagcatgcgcagcaaaatccccagaatcacggtggtgacagggttgcgcacatgcagcggatcgcgcagcaggctttttaaccacagacgaataccgccgtcgatccacagggtgatctgcacaatcaaggccagaaaccaactgtgagagatcgtggcgcgccaggcgtcgggtaaatcgataaagcgcagggcaatgagcagggaaaaaatcagcagcagcaactggctggtgctgcgtaagatctcgaccagaatgccggtaaaacggacgtggcgtgcttcgctgtagtgggcaatacggttagaggtaaaacgaatcaggctgcgcagcaaccagtaaatgaccagggtggcaacgatgacgacagcgctgttgatccagagcgtttgattgaaaaaaattgactgaaaatgacgcgaattgagccagttttccattggggatgttctccttgctggttccggttaaacgagaaagcaagggaaagcatagcctggatgcgccgccggtgtgcggcgcagggtgaatcgcgggttactggaagcgttgtgctttgtcgcgcgcctggcgctctaaggcaaaaataatttgctgtaactgccgttcctgatggggttcaagcgcggtaaaacggaaactcaggcgaggggttactttcgtctcatttttattggtaataatgctgcgctcgccaatatgcatcagcttagcgctgacgttgaactgaccgaattcacccagttcgacctgcaggctgctaaaatcatccccgctttttagcccctccggcattgtctcttcgaccagcacgccaatcccgcccagggacagatcttgcaagcgcaggcgagccggcgagccatcaggccactggcaatggcaccaaaactccgggtccatcggggcgctgatacggaaaaattcccgacgctggatttgccaaaggacgtccggcagggcggcctgaaaagcaggcagtccctcaaagtcggttttttccagtgttcccagggcgaattcaattttggcaccgtgggtttcggcaaaaatcgtgatttcattgcagtgcagcgcgtagtcgttatccaggttattgctccccagatcaaaaacgatacgtgtttcatcggcagcgagcatacggctaataaactgcccgcgtgaaaaattcaccagcaaaggtgtttgtaactgaagcaggtccttcatcacgccaagcacggccagcgtgccacgtttcaggtactgttctttatcgttttctttcacttgctggctccagatgagcaacgctttttcatgtaattatcctgttactacccgtacgttatcggcggagaataataaagctttaacacaataaccactatcattacctgcttgcgctacatttttaaaaaacatgtctatactatgcgcagtgaaccgcttgattaatcaggcgatcgccattgactaacaaaaggaaggagtaacggatgggtattatttcatggatcatctttggtttaatcgccggtatcctggcgaagtggatcatgccaggtaaagatggtggtggcttcatcattaccgtgattctgggtattatcggtgccgtagtcggtggttggatcagtaccttcttcggctttggccgtgtggacgggttcaacttcggtagcttcgttgtcgcggtaattggcgccatcgttgtgctgtttatctaccgcaaagtgcgcagttaacgcagaacttgacgtaaaaaagggcccgcaggtgactgcgggcctttttttatcgtggcgaaggtcagctatcggttacttcgcgttgctttgcgcctcgggaatatcgtgtgcgctgttacaggttttatctttcgggcaatatttatccagcagtttcagggtgacgccgttggtccagccaaagccatcctgcaacggatattcaccgccgccaccgccgcccaggttcgcgccctccaccacatatttttcgaccagcttatgttccttgtcataggtcagctgtacgttacgcaggaaacgtaagccaacctgctgtgcaagctggggctttttatagtgctccaggccttctaccgcaacccactgcagcggagcccagccattaggcgcatcccactgttgaccgttgttcaccgtggtggtcaccagaccgcccggtttcagcagctgtttttccactgcgctggcggtgctgtcagcctgtttatcactggcgatctgcatatagagcggaaacagcgtggcagcggtgagctgtggatggatctggcgtttcttccagtcatagtccgcgtaccagccctgtttgctgtcccacaggtaacggttgatcgccgcctgacgtttctctgcccggtcagcaaaaaacctcgcccgatcgtcctgcttgttcaggcggtaagcggtggacagggttttttccagatggaacatcaggctgttgagatccaccggtgccagctgtgtcgtgcggatggtggaaagattgtgcgcgtcggtaaaccagcgtgaactgaagtcccagcccgaggcggcaccggcacgcagttcgcggtacatctctgccttgttacgctgcggggctttattcgccgtcgtaatatcatccatccaggattccgtgcgcggaacgtcgcgcgcatcccagtagcgatttaacagcgtgccgtcggccagcttgatcacccgtttgctggcgttgcccgccgcaacgctgtcgctgtctgccatccagtagtcgtactctttttgcaactggggcaaatagcgcgtgtaggctttgtcgccctcatgcgttgccagcaggtcaaccatcaggctaaagaacggcggttgtgaccggctcaggtagtaagtccggttgccattaggaatgtggccatagcgatccagcagggaagcaaagttatcgaccatatcctgcactttgtcccagtggccgctttctgccaggcccagcatggtgaaatagctgtcccagtaatagacctcacggaatcgcccgcccggcaccacataaggtttaggcagcgacagcagggagtcatattttcccacgctgttggtggtacgcgttaacaccggccacaggccattaatatggtcgcgcaggttctggcctgctggtggcacatatttatcgccatcggtgggcagggtgaaatttgctgcgacaaaacgttttaaatcgaagccgcgctggtttttctgcatctgccagtcggcgagaattgacgagggatcgtacttaggtaccgcgtcggcaaaggttttttgatcggggtagaattttgcctgttgcacggcattaaacagcggccctaaacggacatccggcggctgcggttgcgtgttcagtaatcgggaatcctctgctgcccaggtgctgaatacgctggcgctcagtagcacgctaagcagaatgggtgcatggcgttgaggccgtttattcgtttttacctcagtgttcatcatcggtgtttctccttgtccgaaatgcggccctgtgtaacgcattgaccacccaacaactttagaccttaaccgcaattttcacccttcagtgcgacggaaatgtgaagcggcaggaattatttatttgcggtatgttagaaaaaagatgcttttacagggcaccgcttgcccttgtgcacatttatccgaagctgaaataaaaggagagcagtatggagatcgtctggtttcatccgtcgcagagcgcaccggactggatacatggcctgcagcaacgtttgccccaggcccgcgtgcgcctgtgggctccaggggataacgccccggcagactatgcgctggtgcgctcgccgccgccagagatgctgcgcggccaccacgatctgaagggcgtgtttgcccttggcgcgggtgtggatgagatcttgcgtcaactgcagcagtacccggatatgctgacggacaacgtcccgctctatcggctggaagacaccggcatggcgcggcaaatgcaggagtacgcactgtgccgcgtattaggctggttccgacgctttgacgactatcaacagcagcagcagtcggcgcagtggcagcctttgccgtcatatccgcgtgaaacctttcacatcggcattttaggcgcaggcgtgcttgggcagcaggtcgccgaaagtcttagcgcccttggatttccgctgcgcgtctggagccgctctgcgaagcagatccccggcgtgaccagctttgccggaccggcggcgcgggatgattttttgcgtgaaacccgggtgctgatcaacctgctgcccagcacagcggaaacgcgcaatttgattgatcataagctgttacagcagttgccgcagggggcgtttttccttaacctcgcccgtggggatcaggtggtggaagcggatttactcgccgcccttgatagcggacagctgaagggcgccgcactggatgtgtttcagaccgagccgctgcctgccgatcatcccttatggttccatccgcgcgtaacaattacgcctcataatgcggcggtcacgctgaaagaagaagcgatggactttattgcccgtgccatcgttcagctcgaagcgggtggacatcctcagggctacgtcgatcgccagcgtggctattaatcactgatgccttaaccggctttttgcaggagcagataatgtatccggtagatctccatatgcacacggttgccagtacccacgcctacagcacgctgcatgactatgtggcgcaggctaaattaaatggcctgaagctgtttgccattaccgatcacggcccggacatggccgatgcaccgcactactggcatttcgtcaatatgcgcatctggcctcggatcattgatggcgtggcgattctgcgcggtatcgaggccaatattaagaaccagcagggcgagattgactgctccggaccgatgctggaatcgctggatttgattgtcgcgggctttcacgaaccggtttatgccccgcgcgatctgacgcagaataccgaggcgatgattgccgccatggcgggtggactggttcacatcatcagccatcccggcaacccaaaatatcccgtcgacattcccgccattaccgaagccgccgcgcactacgatgtggcgctggagctcaacaactcctcctttacccattcccgtcccggcagtgaacccaactgtcgggcgattgccgaggcagtcggcaaagcgggcgggcggctggcgtttggctcggattcccacacggccttcaccctcggcaacttcgagcactgcctgcgcatcgccagagaagtggattttccggaggaacgcgtgttaaatgtcacgccgcgccgtctgctggactttctggcaatgcgtaccggcaaaccgatcccggaattggcggacttttaacttcgcttcctcaaggaatgttgatgcatgaatgcgtttttcattctgtgccgtattgttggatgctcattcatgaaggcatattctcggcgttaagttaactgagttacaggctgattgttttttagccgcccggcatctgacgacgctaaggtttaagagccagcctgtgacagataaaggaggggaatagcttttttaacgaatatatatagccgtggagagtggtgttttgcaccaacactgcaaggttactatcgcgctttatcgttctcgtgacttgcttcccgtttagttgacacgttgccccgacgatattgccaaaccgcaatttacaccggtttgaaaacgttccgatatatcagataagattaatcattgctcaactgaaggttgaagatatggacgctaaaatgattgctcatggtatatgggacagtattaagtaaattcctcagagtgcatattatggagctaaacgcacctatataaatacaggtgcgttgggttatgaccgtaagttgcgtaacgaacgtgagaacgatcggttctattacgtggtaaaatcacttgccagcaatgaagaaccccttcgtcgacttgtaaccatagttatcactgagttctacgacaaacttgatgagcagggtaaagaagccgttcacaatcagttggcctacggtgcgggacgtattggtgggagaatgggcggtcaattagctgtatctcaggcattaacaatggcaatcgtcaaaaacgctcgcagtacttacgcttacaaatcattgtttcgttatggtatcagtttctctgtcagcaccgccttatggcaaaggctaattgaggaagctgccttagcaagcagacgtatggcgaatcattatagttctatgtactggaaggtacagccgcaagggcttgatatgatctacttcgtcgttgaagatcaactaaaaccctatctcgattttatcagcagccattctcagacgtgcaaaaggatcaataatgaaatttgtaaaatggctgggtaaactctcggcgcatcttctcgagggtactattacaattattatgagttttttagcgcttgcttcactgtatatttttgatagcttggctttgaaactgtgcggcttctttggcgcttttatcatcggctatggtgctgcttatttcctcggtaaagtcaggggagagcataaggaataatgagtttcagtagttcaccggctgcctgatagcttgtgcaactcccccgttgattcatacaccgcgatgttagaaatgcctgtaacatgaccctcggcaacttcgagcactgcctgcgcatcgccagagaagtggattttcccgaagatcgcgtgttaaatgtcacgccgcgccgcctgctggactttctggcaatgcgtaccggcaaacctatcgccgagctggcggacttttaatttctctccctcaaggaatgttgatgcatgaatgagttttccattctgtgccgtattatcggttcgctgtttaaccgccatccgcaggatgcgctgctggccccgctgtttacgctgattcgtgaaggtaaactggcggcgcagtggccgctggagcaggatgagctgttgacgcgcttacagcaaaacagcgatccgcaggcgctggcggcagactacgatgccctgtttgtgggcagcgactgcaaggtgtcgccgtttgcgtctgactggccggaaggaaagccggagtccgacatccgcgcgtttttgaccgcgcgcggcatgccgctgggtgatgcaccggccgaccactttggtggcctgttgctggcggcgtcatggctggaagatcagtcggcagcggatgaaaacgcggcccagctggcgctgtttgacgagtaccttatgccatggtgcggcgcgtttctcggcaaagttgaagcccatgccaccacggcgttttatcgtaccctggcgctactgagccgtgaggcgattcaggccatgtacgatgagctggtggaaagcgccagcgagcagggcgacgacgcctgattcaccattgcgccggatgcgtacccggcgggcttcctggcgtggcgcactgtaatgtggtgccaggcagccaggcggcggatcgcaacctgataccaatgccccacggcgtcagctctaaacagggctgattgtccctgcgctgcggcgtaatgccggtctgctgcgcgttcgcgccgtagcggtgctgctcaagtagccaggcggtgcgcgccagcgacaggcgcatctgactgccgttgccgtgctggagtcgctggcgcagtcccgccagcactgcggcggccatcaggtagccggtggcatgatccagcgcctgtaccggaagcggtagcggcgcatcatgctgtttccatcgcattccctgttcggcaatgccacaacccatctgcaccagactgtcgaaaccgcgccggttacgccacggtccctgccagccccaggcgtttaaactgacgtcgaccaggccggggcagagcgcctgtcgcgattccgcatctaatcccagcttttccagtgcgtcggcgcggtagccgtgcacaatcacatccgcttgtttcagcaaccagacaaactgcgcccggtcggcaggctgttttaaatccagcacggcccgacgtttgccgcaggacagctcctcgtccactccaggctcttgccagccgggcggatcgatccgtaagacgtttgcgcccaggctggcaagaaaccgcgtcgccaccggaccggcaataatgcgcgtcagatccaggacgttaatgccgagtaacgggcgcgcctcgggcaatgcccactcgacggcgggaccgtcggccaggggttgtcgggcgaacagcggttcatgtatgacggccatcccctgcggatgctgctgccatgcgtcggcgctgcgcatttccgccgcgcaaccgccggcctcaatcaccgcctgttccagttcggcggcctgccagtgagccacttcacgcgccagcgccgtccggtccgggtgacggccaaggatactttccattgccaggcgatgatggggagcattggtatgcaggcgaatccagccgttttgacaggcgtaatcccccgcaaaagggtcccacagtgcgggcgcactgcgattaagcggcataaagctgtgctgaaaccagcgggatgccagccggacgttaacctgtgcgcgggcaggacggttaagcagatcggccacgccctgcatggctaagcccaggctggtcgccgccagttcactgacggcataagcggaagaaaaagtggcgggatcggtcaataagggcagcggctgcggcgcatgattgccatgcaatccttgccacatctgctgccacagcgagctggtcaacgtattcatgcaacaggctccagagttaacaccttctctgaagcatagcagcctgaactaacggcgtcgcaggcgcgggaaccgggcgtgcattcgcagattgcgcaggttaatcaccgcaatggtggttcccaggatgaccagcgaggcaccaatgattttgaagctgttcaggctgtcacccaacaccacgatgcccattaataccgcgagaaccggcgttagcagcgagtagggcatgatcaggttaacgttgtatttcttcagcaacgcataccataaggtgtacgccacaaccgaggaggcgatagcactatagagaatggcaaaccagccgcgccagcccgcatgttgcagcgcatagagctgattggactccagcataaagctggcggcaccaacaatcggcagggcaaggaaggcgatccaccctgtcagcgtcagaggcttaatcggcggcgattttttcacaatcaggttgctgatggcccagccggtggcgctgcacagcagtatacacagcacccaccaggcaggaatggtcgggctaccggacagcaccaccacgccactgagcgagatcataatgccgatcagctgaatcagccgcagcttctctttcagcaccaccatcgccaacagcatggcaatcggcgtacccaactgcaccacaatggcacccgttccggcatcggtataacgcatgccgacaaacagcagtgagaaatgcataaaaccaaacgtgaaggccagcagcactaaccagggcagctgctgacggttaatacggcaaaacgggacgagcacaatcgccaccaccgcaaaacgcatccacgtgagaaacaacggcggtaactcaactaatccccattttactgccacgttattaaaggcccagatgcaaaccaccatcagaaccataaagaaatgccgcactgccacaatgtcatcctttaaaaataaacccgatacctgctaatcatggcacgaacctgcgatgttctggcaatgattaacattttttatttagttaagcagaaaataacgccaaaaaaattcataagacttttacaatcgttactgtcagactgatcttccgaaacgccaacccttttgaggattcgattcggtatgatttccacgcctgtattgccccttgcccttatccagttagatgttcctcccgccaacgtggtcgagaaaatcggtgaacaaccggtatggtttatcgaggcgctgaatttacaacccgacgattaccttattgtccgtccccatctgggcgaaacgctgccgcagtttactgaaatctcgggtgcggtgttgagcggttcgtgggcgatggtgaccgatcatgcggactggagtgaacgcacggcggcctggattcgggcggcaatggaggcgcgtttaccgctgctcggcgtctgctacggacaccagcttatggcttatgcattgggggggaaggtggacgataaccccaatgactgggagcgcgggctgattaggttaaccacgacgccgcaggcccgccacgatcctctgctggccaccttgccagatacctttgaggcctggctttcacatcgtcagtcggtgattacgccgccagctcacgcgaaggtgctggccgtatcggaaaaggatggctgccagatattgcgctattcatcctgtgcgctgtcggtgcagtttcatccggagtttgaccgccgcattatggacgcgtgcctgccggaagcctgtgagcgcgacggggaagaactgcagggggcggactgggcgcgcagcgtcttataccatttctggttgcaaacgcgcccggcggttaacagcgctcagggcgcatagtggcgggtacagcgataaacccaggctggcggaacgttttttaatacccgtcggcgttcccaggtaaagtaacgtgacagatcgggctgggtcagtgaggtgtactggaactgcacaaagacgccgttgggtcccagggcgtgataaaccgcctgcagaatggcatcgcgcagttccggcgacaacgacaacagcggcaggccagaaaagatggcgtcatagctgccgttgaggtactccgctgaacaggtgcgcaccgtcattcgcgcgtcatccagcgcgctcagcttttgcgccagcgtgctgctgatttcaaacacatccagcgtcgcgttcggggccatctgagccagcaggcgacgcgttagcacaccgtctcccgcacccaactcggcaatccgcaactgactgttccattccaccgattcaaccatggtgcggcacagcgcatcagaggaaggagtaatgctgcccattttgcgcggattacggatgaactggtggacgaaatctgctttagcgcgcattaaggtgaaagccgaagctaacatgcttacttacctccagagtgaacatatccccatattgaccccatcgtgctcaaaagtttccagttaactggcgaagcggcaaaaagtcggaattatctgtagtgcgcccatcgcggattttccttcgtcgcggtcacagtttagggataacaaacctgtcaggctgacgctgatctaatatgttaacaataggtttcaaagttgtttcacatcctactgcgtaaggagattcaacatgcgttatgctgcgccaggagaacccggttctctcatcacgttgcaaaagcactatggcaatttcatcaacggtgagttcgttgcgccggtcaatggcaactacttcagcaatacctcgccggttaatggctctgacgccggcgcctttccccgctcagacaaggccgatgtcgataacgcggtcgccgccgctgcggctgcggcggacgcatgggggaaaacctcgcctcaacagcgcgcgctggtgctgctcaggattgccgaccggctggaagagaagcttgaatatatggcggtgaatgaaacctgggacaacggtaaaccggtgcgggaaaccctggccgctgatatgccgctggcggtggatcacttccgctattttgccggttgcgtgagagcgcaggagggcagcgccgcagagatcgacgaatttaccgccgcctatcacttccatgagccactgggcgtggtagcgcaaatcatcccgtggaactttccgctgctgatggcggcgtggaagctggcaccggcactgggggcaggcaactgcgtagtgcttaagcccgcagagcagacgccgctgtcgatcaccctgtttgttgacctgatcaaagatctgcttcctccgggcgtgcttaacgtggtccacggttatggtaaagaagccggtgaggcgctggcttcacatccgggcattgccaaagtggcctttaccggatcgacggccacgggcggccatatcctggaactggccgcgaaaagcttgattccgtctaccgttgagctgggcggcaaatcgccaaacatcttcttcgaagacattatgcaggccgaagagagctttattgagaaagcggcggaaggcgttgtgctcggcttcctcaatcagggcgaagtctgtacctgtccatcacgggcgctggtgcaggagtcgatttacgaaccctttatggcggcggtgctcaaacgtatcaaaaccatcaagcgcggcgatcccatggatacggagacgatggtgggcgcgcaggcctctcagcagcagttcgataaaatcctctcttatctggaaatcgcccgtcaggaaggtgccgaggtgctgatcggcgggggcgttgagaagctcgatgactcgcttgccagcggttactacatccagcccacgttgctgaaaggcaacaacagcatgcgggtgttccaggaagagatctttggtccggtggtgggcattaccacctttaaggacgaagcggaggccatcgccattgctaacgactccatctatggcctgggcgcgggtgtctggacacgtgatatcaaccgggcctatcgcgtcggacgggcgattaaagccggtcgcgtctggaccaactgctatcacctttatcccgctcatgccgcctttggaggctataaaaaatcaggcattgggcgcgagacacataagatgatgctcgatcactatcagcagaccaaaaacctgttggtgagctacagcattcagccgctgggcttcttctgaccgggggcggcgtgcctggcgcacgccgctgttttcgcctgtgggctgtcatataagcgtaatctgcttgtgacatggtgctcagcagctattatcgatccctggcaatgatcatatcgtgcctgtgtttgctgtatgacctgcttcactatggataacggaacagagacgatttatgcaaaatccttatgaatatttgagcctgatggatgatgtgcttgatggacctgaagacagcatcattattgtgaatttgccagagcgccaccgcgcttacccgatttgtccgcagcaggctgaaggtgcagcattctcagcccgcgcgccgcagtccgcagcctcatcgccgcgtcaggatgtcctgttctgacagcctgtccctgtcgtctggctggcgcagatgtggcctggccggacgcacagcgcccctgtgtagcccagcaatcccgccgtatgattcccggctttcacctcttcccggtcatgcattagcccgcaccccggcgatgttgacgcctggctgaatatccccaatcattcccgtgcgcggttgtcagcctgaccgggttaaggctttcctgcggcactgcgccgtgccagcaatcaacccgcaagcgcggcgaaaacggagcgggcctgtaacgaagtatgatcggcgtcgatattgacattacgcgcgaaaattacccttttgtgccagttgcgggctgatatcgataagaaaagttaacctttcatcaaccagctgaaaagagttagcaccggttgataatttctgcgccagatcgggcgtgcggatgtcatcaaaatttacatataccattaataaaatttaacttatcccgctatagattacttatggcagcgcatgtcggcgattttatcagcaaggaatgaggtattttattaatgagtaaattaacccgaagaagttttatggcgtttgccgcaggcgggacggtggcgctggcggctggacaggttcatgcgcatgacagcattcagtcctttccgaccggtggtcgcgatcccgggccgcacgatcccatccgcgaagcagaaaatccggatattgttaatccaccttcgaccgacagcgggacgttaccgaacctgcgtttttcattcagtgatgcgcacgtgcgcaaaagcagcggcggatggacgcgccaggtcaccaagcgtgaattagccatttcgaccaccattgccggcgtggacatgcgcctgaatgccggcggcatccgcgaattacactggcataaagagggcgaatgggcctacatgacctacggcaacgcccgcgtcaccgcgtttgatactgatggcagttggtttatcgatgatattggcccgggagacttatggtattttccgccgggcatcccgcactcaattcagggcatcgggcctgatggatgcgagtttctgctggccttcgacgatggcggatttgatgaggacagcacgtttctgttatccgactggttcaaacatatcccgccggacattctggcgaaaaacttcaacgtcccggtatccaccttcgaccacctgccttcgccagcggatgaatatatttttgccgcgaaggtgcccggcagcctggagtcagtggcggtgaaaggcgcaaccaaagccaaacgcacctttacccaccacatgctggcacaggaacccataaaggcaccaggcggcacggtcagaatcaccgactcctcaacctttaaggtgtccaaaaccatcgcggcagccctggttgaaatcgcccccggtggattacgcgagttgcactggcacccgaataacgatgaatggcaatactacctggaaggggaaggacgcatgggcgtttttgcctcatcgggtcaggcaagaacatttgattatcgggcaggggatgtcggctatgtgcccttcgccatgggccactatgttgaaaacaccggcaaggggccgctgcgtttcctggagttattcaaaagtgactattacgccgatatctcactcaatcagtggctggccggtacgccgcgtgagctggtaaaagcgcatctccagttagatgacgcatttatggatgcgctgtcgctgcagaaaaatcctgtggtgaaataacgcgcatggctgcctgtcggccatgattgccacaggttgtgggtctgttttacggctgcgtggacagcccacgcttttttcccaaaccccaaactatgacccgacggctgccgtgctgccctgatgaaaaatcatctgccagccatgcgctgcggataaaacccagtgggacgaacgtaatgcggcacggctgccgtccggctgtgaggtgcggtaaagcaaaatggcatgctgggttccgacctccatcagttgaaagtcgctgctgataatggcctgcgcgcgctcttcattcatgagcgccgcgatgatttgctcacggttcagcagcgtgcctgaaagggtgatctctttaaattcaggatgcagtgtctgttcaagccacgctaaatcgtggcgcttttcatgatgcaggctgcattccagctgtttaagcacatctaacatgacgttctccggtgaaaacagcgtcgtcaggtttcatcctcaagcggcgctgagtgatggataacctcaacctctgacctgagctgaatcgccggataatgcgcctgcattcctgctaacagcaccgcatcgggccactcatcgtctttacccagatactgcgccacggaggacagcggcagagtgaccacgcgttcaacgttaacgatgacgacggattccgggtcttcgctgctgatatagcgcagcggtcctggggtgatgttggcttcctgccagcgtatcgtatgacgtttttcccccgcccgcagcgctttcatcaggcggggcacgatgtgcagcgtttgcattgatgactccgggtaagttaacggctgtcgtaaatccgggcaggccaatcgcccaaccgggctgattctggcgtcatgggcagggattaaagcgcgacagccagcgctggcgcagttccctggcctgtcgcgacactgccgccgtgtcgctggcatgaaagccatgaaaggcaccgggccagacgtgcagctccacggcgacaccggcacggatcagccgttgtgcgtagtcgaggttctcatccagaaacaggtccagcgttcctacacctatccagacgggcggaagcccggcgaggttgctggcgcgtgccggtgcggcataaggcgagatcgtttcgctgccgggttcctcgcccagcagtgcggtccagccaatacgattatattcgcgcgtccaggcaaactcgccggtcacgggattgggatgcgtttccgtcaccgtgcggtcatccagcatcgggaacatcagattctggaaggccagtttggggccatcgcgatcccttgccagcagcgccagcgaggcggccaacccggcacaggcgctgtcgcccattaaaccaatgtgtgccggatcgatgcccagcatgtcggcctgacgcaccatccagttcagtaccacatagcagtcctccagcgaacctggaaaaaccgtttccggtgacaggcgatagtccactgagaccacgacgcagttgtggcgcagtgccgttacgctggtcagtgaaagggattgctccgggctgccaaacagatgaccgccgccatgaatatgcaaaatgcccattcgccttggggtcgcgctgaccggggtaatcacacagactctgacgggcggatggtcgggggaatcgatgctgtgttcttcaatgtacagtccgccgtcacggtaggtctgaacctgttttacggcggcgtcctggcgttcgcggcgcagcgccacaatggtttccggggtaagctcaagcggcgcgctgtttgccagggcgggcagcagttcgggatcgaccagatgcagggtgttcaaatcaaccttctccttggggttcagatggcagtcagtctgtctgccgcatcagcatggcagaggctgaaataacatgacctgccgacagcgcctgcctgcaggtcatggtcatggcgataaaccggatcagcagccggtgtcttcaccgttagaggcaatcaactttttataccagtgatagctctttttcaatgaacgcgtctgggtgccgttgcccatatcatcctgatccacgtaaataaaaccatagcgtttggacatctgcccggtgccggcactgacgacgtcgatcggcccccaccaggtatagccaaacagtgcaacgccgtcggcaatcgcttctttcatctgcgccacatgctggcgcaggtagtcgatacggtaatcatcatcaatgctgccgtcagccttgacggtatccaccgcacccagaccgttttcggcgataaagagcggcttttgatagcggtcataaagctgattcagggccagccgcaggcctttgggatcgatttgccaaccccattcactggtcgccagatgcgggttacgaatcccgccggtaatcaggttgccctgcgcgccggtcagtttttccggctgggcgctgacggtgctggacatgtaatagctgaaggaaacaaagtccaccggatgttgccgcaggatctcatcgtcgcccacggccttaatgagctgcacgcctttctccgccagcattctgtcggcataagccggataataaccgcgcgcctgcacatcgctaaaaaataacgacacgcgctgcatctcttcacaggcctgtacgtcatccggatggcaggtgtgcggatagaggatctgatagctgatcatacagcccacctgagaaccggggataatcgcgtggcacgctttggtggccagcgcgctggcgacaaactgatggtgcgcgccctgatatttatcttgctccaggtgaggatgaccttcttcaatcacgcccacgctcacatatggatggtgcttcacgcagttgatctcgttaaaggtcatccagtacttcacttttttgcgatagcgggtgaataccgtggtggcaaagcggacataaaagtccaccagttggcggttcggccagccaccgtagtctgtcaccagcgccagcggcatctcgtaatgcgacagcgagacaatgggttcaataccctgtgcgagcagggcatccagtacctgatcataaaactgcaggcccgcctcgttgggttccgcctcatcgccgcgcggaaagatgcgcgtccaggcaatcgacatacgaaagcatttaaatcccataccggcgaacagcgcgatatcctctttgaaatgggtgtaaaagccgttgcctttgcgcttgggataatactttttactgtctgggttctgggcttctgcgacctgagcatgcgtcatgctgagccactgatccagccattgtgattgcggggtagccgtgtcaaaagtatacacatcggaaaccgataatcctttgccaccgacatcccaggcaccttcaagctgattcgcggcggttgctccgccccacaaaaatccctcaggaaaggctgttggatacgtcatattttgctccttaaaccgctgcggcggtgagtgtcagaaaggcatcgcgacaggcgatgttcccggtggctttgaccgggtggatagcgccatagcgctcgctgttagtcacaatcacaattacgctcgggtcgatgccttcggcctgaagcgcggccagatcgaacgtgactaacagatcgcccgtgccgataaactgcccgggctgaatatggctggtgaagtggcggccgccgagtttgacggtgtcgatgccaatgtggatcaggatttccgcaccggtgtcgctcttcagccccagcgcatggtgggtttcaaacagcgactcgactcggccgtccaccggagaacgcagttcgccaactgtcgggtagatagccagtcctttaccaaaaatctcgtcggcaaaaaccggatcggccagcgcactcagcggcgtaatctcaccactcacgggcgcaaagagtttttcgggatcgtgacgatgaagaccgggtgcggacgccacatcggcggcggactgctgggtcgactcatcaaaacccagcagcacggtgagcagggcggcgctgccaaaggcgattgccagactgaacagggcatagataaaggtcgggccgaccagcgcgggaatgccgggcagtccgctgagcgcaaacgcataggtttttacccccatagccatcgcaaatgcgccgccgcaggccccgccgagcagggcggcggcaaacggccgtttgtaacgaatattgatgccgtacatcgcgggttcggtaatgcccattgcggcgctgaagctggtggtgagcgccagtgacttgagctttttatctttggcccgcaggaatacgccgaatgccgcacctgcctgaccgagattggcaacataaaacaggattttaaacgggtcgaagcccagttggctgatgttgtggatcatcacgggcaccagcacatagtgcataccggtaataataatcagcgataatgtcccgcccaccacaatgccggcgacaatccccatgttttcgaccagccagataataccgccggtcagcgcattaccggcaaagatccccaacgggccgatggcgataagcgtaatgggtgtgacaatcagcaggctcaggagcggaacaaacatggttttcagcgccgcgggcatcaggctgtcgatcaggcgttccacatagctcagcagccatatcgacagcagcaccggaatcaccgtcgaggcataattcaccgcgggcacgggtaatcccagaaagtggatcggctcaccggcgttgaacagggtttgcagggcagggtgaaagagcgaggccgccagcgccacggcgacgtaaggattggcaccaaaccgcctggccgcactgaacgccagcgccagcggcaggaaataaaacacgccgtcgctgatggctaacagcacctgatagctctggttatgcgcttcaagccagtgaaacgccaccaacagcgccagtattcccttgaggataccggcaccggcaatggcgggaataatgggcgaaaagatgctggataatccctccagcagcgccgaaacgggatggctgcgcgacgtggcgcgctgcggggtgtcctgtaatggcaactggctcagcagcgccttgcacaaggggtcaacctcattgccaatgattagctgaaactgatcgccagaaaggttaacgcccatcacgccatccagcgcttcaagcgcctgacggtcggccaggctgttatctttaagtaaaaaacgcaggcgagtaatgcagtgaaataaagacagtacgttatctttcccgccaatcagtgtaatgatttgctgtgcggtgtcctgataattcataaatccctccagactgaagtcaatatgacgtcatccacaatgaccggggttaaccgggtgggtaggcttctggggtttgcctgattgaacagtcacaagccggaatgggtttttcattacgttttagggggtaaaacctcgggcgcgctgcgctgcacaatattttcgatgtgcactgtcaaatagagtttttcagagttgctcatgctgtggtgataatgttttttaacaaactcattaatggcgtcaacgcatttaagggtgcgcgcgtaacgctgctgcgccagcgcaaaaaactcgtcatcgttattatttaacacctcgccatcgatgacccgctgggcaaaaaatttcaggtgcgtaataaaacgctggtaattcaggctgtgttcatcggtatgaagggtaaaaaagtattttacgatttgttgcagctgataaaggagttgggtaatttttgcggtttttcccagcgtgtcgttaagcccggcgttaacgatatgcagtgcaatgctacaggcttcactgtccggtaacagcatgccggtgcgggcgaccaccatgcccagcgcctgacggccaatcgcatactcagcggtgtaaaagtggcgcacttcccactccagtggattcgcgagcagcgcgttatttttatgacgttccagggcaaaatgaagatggtcggccagcgtaacatacagcccttcacttaatttatgattcagcttttcgcgcgccaggctgacaatatcggcggtaagctggagaatatcgatagggacttcactgaccagatctttaaagcgtgcagagatcgatgaatcttccagacgaaatattttttctgcctcgtgaggatgaatactggcaccgttgtgcgtattaaatcccagaccgcgtccggtcaaaataacttcaaggccgttatcatcaatcgcactgaccacattattattcagtatttgtctgaccagcatcgctcactcctgaaacaaaatcgggcaaaacataaatacagcggtgaagggaatatcccccagcctgcattcaggttttgcccgataatcggtaacaagcgtgatgccgatttatcctggcactgtgaaaatggagattcaatattaaattgtgcagtgggttatctgacgcgccgatttgtgatccgctttgcgaaaagcattacagcaagctgttacgcaatgggggaatcccaaatgaaatcaccctttttcacgaagcggaccgcttccggcagagaaacacgctaaacaagggcgagatcatcgcgcgcaggttgcctgccatctgcacattgtcaggctgcctgtctcggcgcgatgcttagccttgtgcctggcgtttttgcgcccccgtaaggagttgctccagcacgtcgatacggtgccggtgtggcgtggtaatggcgtagaagcgctcctgcaactccgccgattggcctacggtgacaaggataccggtacgcagttcatcctgaaccacgacctcgggcaatacggtgagccagccgctgtcgcgagcgatcagacgcagcatagccatgtcgtccacttcagcgcgcactctgggcgttacgcccgccgcagaacacagcacatcaaactgcgcgcgcaaggcatgacgtgggccgggcaaggcaatttccacgttatccagatcttccgggatgcgcagacggcgcgatgcccatttgctcgccgggccgactaaagagatggactgactgcccagatacacgaagtgcaaaggacgatcggggtccacgggaacggtctcattggccagcaccacatcgagctgatgttgcatcaacctgaccagcaggccttccagcaatccggactccagtgtcagcaagacagtagggtcggtaagcgcaggccgaatccagttttcctgataattgcgcgacagggttgccacgctgcccacacgtaaccgtgtgacaccggctgaacggccttttaagcgtcccagcatctcctggctaagtccaaaaatattgtcggcataagccatgaccagctgacctgtgtccgtgaggatcaggcggcggcctttgcggattaacaaactttcgccaagccgttcctcaagctgtcggatttgcaccgaaacggccgattgagaggtcgccaactcttcggcagcccgcgtcaggtgcccgagtttggcgacgcgccaaaaataaaaaaggtgatggaaatttaactggttaaggttcatcgttcgtttttaagtatcgaattattcaaataaatatattttacagaatagtttgcgtcaaggaacataccctcagtcacattcataagggctaggcgatgaatatccttgaagctttttacctggtttgttttttagcaccggcaattttaatgttcgggttaacggcactgacgcggtggggcggggtgcctacaccgacgctttggcgtgttttgcagattctgtcgtatggctccattgtcttcaccggactgtctcttaccgcggacatccgtgtcgtgcaatggcccggcatagtcaaagccacgacgtttggcctggtgttggctttgctggtgcaactgctcggcaacgtcatcgcgtcgttttctgcgcgttatcttgaaggggaagccaaccagcgacgctacatgggcgcactgaccgctgttctgggcagtgtccatctgctcttgctggccgataactggctgctgctcatcgcggcctgggccgctgtaggcatagcgctgcagcacctgctttgcttttatccggatcgcccctttgccctgtttgcggcacacaaaaagtacattgccgatcggatggctgacgtgatgttgctcggcgcttccgcgctggcctggtgggatgtcggcagtttctcgctgtcagccctgtggatgcacatcgcccagcagggtgcgtctgtgtctttgcaggcgagcgccgtattactggtgatggcagttattctccgcacagccttactgcccgtgcatggctggctgatacaggtgatggaagccccaacgccggtatctgcgctgctgcatgccggcgtcgtcaatcttggtggctttgtgctgattcgcttcgcaccgatgatagaacaggccagtgctgcgcgagtcttgttactggtttttgggctgacgaccgcggtgctggcaggcatggtcatgttgacgcgcatcagcataaaagtacgcctggcctggtctaccgtcgcgcaaatgggctttatgctgcttgagtgcgcacttggcctgactaccctggcggctctgcatctcataggtcattcgctctacaaagcacatgcttttctgtccgcgtcagagggcgtaagacacactcgccagcaggcgctgcaccgggtttccttgcccggcacggtgagcgtgcttcttgccccggtattaacgatttcagcggtatttctggtgctgacgctggcaggtcttgccgcctggccctggtggtggagtgttgtgctgagcatggcgtgggcgcccttgctgtggttgcctgacgcgcaagacggttcgacacgtacgctgcaatctcttttcggactcttcacggttatcggcctgacgatgattgccctggctttgcatacgctgccgctcggtttgcaggacgctcctgatgatcgtctgggcctgatcgcgctggcaggtatggcagcactgtatgtctgtcaggtgttactgcaaaagcagccacaacgcttgtcgcgctggcgtcggtggagctacgcgggtttttacctggacgaagcctatacgcgtctgacgctgctcatatggcccgcgcacggggtttccacaacgtccacgcccgctgagtctgacgtccctgatgcacctgttgtcgacaggccgcgctgactaacaccattaaactggagagtttcctgatggatacactgacccacaaagagaaacccgtttcggcgagcctggcgcaatccgcagccaatgcagattcacggcaggttgcgatcgagcaagcctgccagcaggcctgccatgcgattgcacctgcatggccactggatcgcgctatcgctgtcaatccgcattggtcgcgtatcggcatgccggtgcgcaaggtggctgcccggatggcggtgctcggcggtattcaggtcttcccaccgcgagatcggcagagcctggcctggcgcgaaggtcgcattagcatggccgatctgacccaggcgctgcgtcagctacctgaggcgcaagcggccggcctgacggctgaacagtgcacccaggcgctgcacgcaagcgcccggcagggacaattaccgctactcatcgatatgctcgacaacgatccccatcgccacaaaaggttatcctggcggcaagcgatcacgcatcaggttagccagacctgcgccgcttacttcgacgaacatcaggcgagctggcagcccgatcgccaccaggggttgtacaccttctggcgagatactctgaagcatgaccatggtattggtttgttaatgggcttaccgaacatccacaaggctatcaagacgttgccggataacgccatggatgccgggcgctgggtcatcgagcgtttgggcctgcctgaagcggtgtgggcagattatctggaatcggtgttacttaccgtcaatgggtgggcatcctggtgcgcttatctgggctggcaggctgagttggcgggcggcaaggatacgcacctgcgcgacttgctggctattcgtttagcctggggcatgatccttttagaatgcaaagatgatgcggctacccggcaggcatttatctcgcttcagcacgcctggacacaagcccctcaggtgctggaagaggccgaacaggccatgctgattgacgaagtctggcagctggctctggaaaccggctatcagcgtgagttggcgcatcggctgacttcgataaagggccaggaggtgggcgcgcaggctgtcgacgtccaggccgccttctgcattgatgtgcgtagtgaaccgctgcgccgcgccctggaggccgccagtcctggcgtgcagaccatcggctgtgcaggattcttcggccttccgattgcctacacgccgctggctacgcaagcccggcgtccccagttacctggcttacttgcgccttccatagaggtcaacgaccgtattgtctgtgctgattcgtcgcagtgcgaagccgataccgcacggcaaaacgcagccagcagatcgcgtcagacccggtttgccatggccgatcagtggcatgccattagccactggccgggtgccgctttctcttttgtggaagcggccgggttaagctactccgtcaagctgatgaacaggttactgccaggcaaaaaagcacgtccccgggacgacctggatggcttgcccgcgcgctaccgcgagatctgccgtcctcaactggttgggctggatacagcggccaaagttaagctggcggcaggcattctccatgccatgggactgacacaacgtctggcaccgatagtgcttctcgttgggcatggcagccagtcagccaacaatgcccacgcagcggcactggactgcggtgcatgctgtggccagaccggcgaagtgaatgcgcgcagcctggcgcagttgctcaacgaaccagcggttcgccaggggctgaaattgcagggggtgaacgtcccggattccacggcgtttgtggcggcgctgcacaataccaccaccgatgaaatcgagtggtttgatctcgacctgttgccacaaggtgcgcgtgcgcgctgtgcatggttgcaacccatttttaatcaagcctgtgaccaggttcgccgcgcccgcgcgcccgatcttcaactggacccgcgagcgcctaaagatgagttactggggcagttacgtcgtcgcgctaacgacggtgcacaaacccggcctgaatgggggcttgctggcaacgccgcctttctgatcgcgcctcgtcagcgcagccgtggcgtagtcctgagcgggcgcagtttcctgcatgactacgatgccagtcaggatgttgacggtagcctgctggaaggtctgatgaccgccccgatgctggtcacacactggatcaactggcagtatcacgcgtccacttgcgatccgcagaggctgggcagcggcaacaaggtgttgcataacgtcgtgggtggacgcattggcgtcttcgagggcaacggtggcgatctgcgcatcggtctggcactgcagtcgctccatgacggcaagcgttggatgcacgagccgctgcgcctgaccgtggtcatcgatgctccgcaaactgccattgaagcggtaatcgcaaagcatgaggtcatccggcaactgctggataatggctggcttcacctctggcgctttgaggcatccggcttgctgcgctatgaacacggacgctggctcgcggtgcatctggagagtgcctgacgtcgtatccctcccgatcagtaggcggaacacatgccgcggcggcctgtttcagggcagcttctgcacgcgtgacttctgcgttgacgtgcgcaaaaggttgcggacgtcaacgcggcgccatcgggacgtggctgccttgagtctggtatggctgggctgggtggacacagtcaccggcgtcgatgcgcgcatcaggcgaagtgctcgcacaggaacgtcacgaacgcgctcaccttaggactcaccagtcggcgcgacgcgtgcagtacccaaccttcgatagcaggcacctgcgccgtgccccactcgaccaaccggcccgaggctaacgcgtcagcaacggcagagcgaggtaatacggccacgccagcgccagcaagtaccgcatcgcgcgccataaagggcgtcgacaggcacatgactggctgtgggagataagtgcgcacgcggcccgaagcatcgatgatggaccattcgggaaccacggcgcgacccgcgcgtacaaccgctggcagcttcagcggttcttcgtcgtaatgcggctgcggcaggtgtggaggcgcaacaagtaccaggcgatcgttcaaaaacttgcgaccgaccagcgtgtcgtcgtggcggggattgaagcgcaccacgacatcgtagccatcgctcactaaatcgacgaggcgatcttccgcaatgacatcaagtcgtatctcggggtaggcggcgcagaaggccgcgcttaagcgcccaaccgagacatcggcgaataacagcggcacgctaacgcgcaatacgccacgcggctggcctatgcccgcttttagttctgccaccgcttgcgtaatttcgtcaaagggatcaagggtacgcgcgtgcaggatcgcgccttccggcgtcagacgaagcgtgcgcccaccacgttcgatcagccgtactttcatctgctcttccagcgcgctgacatggcgcgacagggtcgctttcggccgtccgctcgcgcggctggcgcgcccaaacccgccatgagtggcaacaagattgaaatcggcgagtgcactaagatccctatttcgttccatatttgagacaaactgttttgtttttaagcactatacgccatttatggttcagtggaagatggggcctctcatcacagggtaaggagttatcaaatgaaagcagtccgtttttatgaatatggcggcccagaggtcctgaaggtagaagatatcgatctacctgaacccggccctggccagatacgcatcgcagtcaaagcggctggcatcaatccgatcgactggaaacttcgcgcgggatatatgcgcgagatgatgccgcttgagcttccggctggcgtgggttacgacgcggcgggcgttgtcgacgccgtagggaaagaggtgaccggcgtgtcagtcggcgatccggtctttggcagaggccatgcgacgatggccgaatatgcgatcctttatgaatgggcacacaagcctgaaaccctttcgtttgaagaggcggcggcgtttccggtggctgtcgagacggccacccgaatcattgcggcgttagcgttgaaagccggtgaaacgctgttagtcagcggtgccgccggtggggtgggctctgcggtcattcaactcgccagggcagcgggcatctataccattggcacggctagcgcggcgaagcatccctatctgcgatcgttgggagcgattccgacgacctacggccccggacttcccgaacgggttgccgcgctagctgtgggcggtgtacaggcggccgtcgacatcgccggctccggtgtcatacctgatttggtggcgatcaccggtacgccgtcaagcgttgtctcaatctccgacctccaggcgcccaagtatggggtgagaacgttgtttgaggacagtaacgccacaccagccctggagcgtgccgcaaagttgtttgtcgcgggtgcgttcacgttgccggtggagcgcaccttcacgcttgaggaggtgtcggctgcgcacgaactcaacgagcagggccatgtgacagggcggctcgttattaccaatggctaagcgtgaaaaaacgggcggatgaatcttgtcatgtttcggatgacgttgcgcctgacgaacgcggcattgagacggctacgacgcggggatcgatcatgaacagcctgcggccagcaggctgatgattggccgtcgtcgccgtcatgatgtcaggccagcaatacatcgtttaacgccaggataataccgctgggttgagcatgacatgtattcggcgcgcgtctgttttttaagcaaagggttgtctttattaaaggaaaagccattataccttttttagatagaaggattttctatgagtgattctgtctgcacatccatcgggctgctcctgtttccggcgcttactcagcttgatcttactggcccgtatgaagtttttgccagggcaccgaacacacaggttcatctcatctggaaaaacctggatcttgtcgtgtccgatcgtggaatggctatacagccaacgaccacatttaaaacctgtccacaactggatgtaatttgtgttcccggtgggccaggacagataaacctgatggacgatgacgacgtcctttcatttatccgttcccaaagcgaacaggccaggctggtgacgtctgtctgcactgggtcgctggttctgggcgcagcagggcttctgaatggatataaagcaacgtcgcactgggcttctctggatcaactcgcgttgttaggtgcggagccggtcaatgagcgcgtagttcgtgaccgtaatcgtatcaccggcgcaggcgtaacatcaggtatcgattttgcgctcaacgttgtgtcagaaattcacggaagcaatattgctcagactattcaactgcatttggaatatgaccccgaacctccctttgcctgcggctcaccccgtaccgcatctaaagaacagttaaaaaacgcacaggagcaggccgcgccttttattgaaaagaggcgacaggcgacgttaaaagcagcagccagactgtttagataagggcgcagtagaagagggggcctttttgactttttatgtttgcttctggcgcgaagcggacggtgggtaggtgatgtctgctatgagcgaggagcggaccttaggcttcagaaaaactcccattctgagccccgaagagtgtccagctgtacaggcggataaaaagctgaacgtcgtcttcggttataaaaatatggcgtattcgcctcacgtgtagtgctgtgtcaggatgtgaacagtggacacactggcagatacgctgaatgatccgaaaaattccgccggtaagtcagatgatcagtcagttcattgagtcctgccgtttgatcgggtagctcaacagtaaccgcgccagggagtttatctatgccggcactgccgcgttgccctgtacctctcagtgagtgacagaagacttaacacaatatttttgccatcagctctctgaaagaggggacatctctgccgaaagagaaatcagggttaatcgccttgcgggcaatgaggccgtctataaacgcaaacaatatgacggtcacttcttcagaattaagatcccggcgtaactcgcctgccgctatgcctttctcgatgatacccgcaatgccctgccgcataattttgtcgctggaaatgaatgttttctgcaaatccgcattacgggcagactccgccattatttcaacccagagatgatgggtgaccgggtaacccacatcgcttatgcaggaagcgacctgtctgcacaggcgatcaaaatgcgaacctgtgtaaggctcatcatgcgccgtcagggccgaattctgctcttccagaacaatggcccgaataagctcatccttgcttttgaaataggtgtacatagcgccttggctgataccagcgcgcgtggagatttcccgcacgctggtagcactgaagcctttttcagcgaagcaggcggcggcggcggtaatcagcttatgataggtttcggtgtcctttaacatagcggccttcgaaagtagattcatactggcactttaacgtgctttcatttcccgggccagagtcagagccaccggtcaggccggtagccctgtttcagaggctgcccttaggggttaccgtatttcgaccttcgcggctttattctgcggacggtatgccagcagaatatatgaccgccgttccgtcaaatatgctgatgcaagctttcctggccggattttcgctaccatataatagttgccgaaaggacttcggtgtatttaccggcactcagagaataatgacgcagagatgaggagaccgtatgcaggccctctccgttcaggttatttcagtaggggcaattcactgagcatattttttaggtttaccatatcccacggcatatgttccgccacggtaagcccaactggttcagccacagagctggcctgattaatgagccggagcacgtcctcaatagtcagcttgccttcggccacatccccaaagtcatgctctccccggccaggacgggcaaacaggaccgagcggaaaagagacgggtccagcacatccagatcgaggtgaatggccagatactcgattttttcacgggcgatccactccatcacctcatgcgcgccggctttaacctgttcagggcttgatgtcgcgatattatgactggccagataatcgctttcataagccagcggatcatgtatgccagcgaccatgatttttgaaggagaaagtctgcgcgtgacgcggtctaccaaatccttgtcaccagtgccgataagcgcacccagcacgtgggcatgggcattcgaatactgttcagctgtctgaacgtcagggtgagaatcaacccagagcacgcccagcttgtcaccgtattttttgagcagatgagcaaatggcgcaagagataccagacagtcaccgcctaaaacgacaagagcatcaggatcatgtttttcaatcagactggccgcatcgttcaactgtccgataatctgaggcttgccggtaattccgtctacttcggtcagtgactggctcccgggtgcggcaacagggacttcctctacaggcccttttgcttcaggagcaagaaaagaaagaagaagcgagccaagatgatagggggcattgtttccgccctgccactggggaaaagaaagtcgaagagtagtcttaaccatatattacctgccttgatttcgttgtcttcgcagcattaccgtgcagtgcggcttctggcctgaaaacctggctgccagggtaatgagccataaaaataatgaatgaacggtcattcattatgggcaatgtacgcattttgcgcaagtaaagcttattcagttaataaagtgcgcatgaaactctggatattagtaatgtcaggtaacgtccgcttctggcacaaagcagaaatcatcgcggagaatctcttttagggttgaaaaaagaacctcgcattcgccatgatttagcctgtccgtatatcgggcttaacctctttgccacggttaagtcctcaataagatgaaatcatcatgattacctacaacgtttttgaacgacactttggggatggtgggggaacaagtggctcgcgcttcgcacagatctcactgaacgaaaattgccgccgtttacaacatcgcgatcccagaccagacaacagaggatgacattgcccagccgttacatctttctttagagcctgtctttctgaatgagcaaaattttacaaggttaaaaatattaagccttcggctccccgtcatatcccatcacgaggcttcgcacgattatgcaaaccgggcacgtagccaatgaataaaagtggttacagccttaggtacctgcgcagtataaggacgcaccacccataagctttcggcaaacgcatctaccgttcgccacgccggcagcacctgctttaatttcccggcagccagcgcggctcttgcactgaaatcagggagtaaagcgataccgagtccctgcaatgcggcatcgcggacggattcgctgttattggtggcaaaatttccgtagcccttcaccatcatggtttcatttccgcccgacactttgtggaaatgccatcgcgggggttcctgtccgcgcagatagtacaaacagttatgctgctcaaggtcgtcgggtttttgagggatgccgtgttgcaaaaggtaagcaggggaggcaaccagaatcgcatgagtgtcacacaatttcagcgcaacatgggtttccggaagggtctggctgtgacgtatggccaaatcaaagccctcgcgggtcagtgacaccagacgatcgttgacatccagctggatatttacctgcgggtattccctgacaaaatcaccaatgatagggaccagttgctgacgcgcaaaagccaccggggcactgacgcgcaccagtcctctcacagggccggtttcgtcacgaatgcttaaaaaggattgctcaatctgcgaaaaaggatcgcgcagattatccaccagtttctcgccgacagaggtcagccggacgctgcgggtggtgcgctgcaccagtgctgtgccggccagcgtctccagttctttgattttttggctcatcgctgccttgctgacctccagcctgtcggcagcgcgagtaaaactccccgtttcagcgagtacagtcagccagtacaaatgtacccacagtccatccgttctgaatgctttcatagggattgttcaaaatagtgaataatcatttcagccctttctctttttattttcaacagcaggcggcaacattgctcaacatcatacatttgcgatttgcgccaaccgaggttttatttatgccgttactaacatttgacatcattgaaggacgatctgccgcagaaatcaaaacaatgctggatgctgcacatcgggctgtgttgaatgcttttaacgttcctgcacgggaccgttaccagattgttcatgaaaataaaaactatcagatggtgttccaggataccgggctgggttttgaacgcaccgagcgcctggtcatggtccgggtgtttacaagcccgaggagtgaagagcaaaaaacgcgcttcatggcggaactggcacgggagctttcagaaaattgtgctgtggacggaaaagacctgatgatcagctttattaccaatgcacccggtgactggagcttcgcggatggagaagcacaatatctgaccggcaagctttaatcaccgcatttgctctgtgttgtcagccgcgttgtttcaaaaaataaggatacctgtatgaacaagcagaagggattctcacaacgcggcggaaagctaacacggcatcatcggctgcctcctgttttgcccgtcatgcgcaacgccatgcccaggcgtaagttgatgcaggtagtaaaggagtcatcaacgctgaagtgaaccgcatttcgtcgaaatgactgacataaagctttatggccccattctgtctctggctgatgattttcctatagctcgccctttattgggaacgaattatatcctgatacgttgaaataacagagttaccatcacttttttatctgactatagcctgccgttataccctgctactaaacaagcattcgtcacctttcaaaacgcatgaaatagtggtttcagaaccttacctttgtctgaaacgagaaatctcatgctaatcccacaaccttatttactttttcttggtgatgttaccgatccactcgcggcgaaaacggcgcgcggtattcatatctggcggccggaacagtgcgttggcgaaattaaactgccgggctgcactgtcagcctgggtctggatgagatcgacatcccccgcgccaaagcgcgcggcgcaaaaaccctggtgctgggtaccgccaacgcaggaggttatctgccagaacactggctggcgacggttaaaagtgccatcgaagcgggcatgaacgttgccagtggattacatcatcgtctggtggacgaacctgaactggtaacgcttgctaagacgtttggtgtggagctttttgacttacgtcatatgcgtccgaagctcaatgtgggcagcggtaagaagcgcacaggtaaacggatactcacggtggggacggactgttcagtgggcaaaatgtacacctcactggcgctggaagcggcgatgcgcgagcgcggaatgaaagcagattttcgcgctacggggcagaccggcattctggttgcgggcgaagggattgctgtggatgcggtcatcgctgattttattgccggtgcggcggaagcgctgtccccggctaatgatgatgaccactgggacatcgttgaaggccagggttcgctgttccatccctcttatgcgggcgtcagtatgggactcatgcacggtgcacaaccgcactggctggtcatgtgtcatgaaatgggtcgcccccatatgcgccatttaccccatcagcccatggtcagcctgaaagcgtgcgttgaagccaatctgcgtgccgcgcaggtgaccagtgagtctgtccagctggctggctttgccattaacacctctaattaccctgaaaaagaagcgcgtgcctattgcgccgaaatcagcgccgagtttggtttaccggcaacggacccggtgcgttttggtattgacgagatcgccgcgctgctgcaggagcgtggttgagatgagacagttgcagattgacgtggtagcgctgccgctggcgcggccctttgctatctcgcgcggtgttcgtaccagcgtaacggttatccgtgtcacgcttgagcaaaacggcttcattgggcaaggcgaatgtacgccgacggcgcgctacgatgagacgccagacagcgttcaggccgagcttgaagcggtacgcgctgacgttgaagcaggcttgagccgccacgatctgcaacaccgtttacccgccggttccgcgcgcaacgtgctggattgtgcgctgtggcgcctggatgccgcacgcgccagtcaaacgctgtggcaaatcagtgcctgttctcagccatcgtcggtggtcacggcggaaaccctcagcctcgatacccagggaaatatggcgctggcggcggcggatgccgtatctcgtggtgccatcctgctcaaaattaagctcgaccgtgatgcggtgctggaaaaagtggcggcaattcgcgctgcggcaccgcgcgccacgctcattatcgatgccaacgaagcctggtcaggtatggatttggaaagcctgctgctggcgcttcaggcttacaacatcgcgatggtcgagcaaccgcttcccgccggtcaggatcatgacctgcaacgtttcaatcatccgattcccgtctgtgctgatgaaagttgccatacgcgggaggatatcgccggactgcgtaatcgttacgagatgatcaacatcaaactggataagtgcggtggactgacggaagcgctggcgatggtcgatgaagcgcaaaagcagaatatgcgcatcatggtcggctgcatgctgggctcatcactggcgatggaagccgcattgcccgtggcggtcaacgcagagcacgtcgacttagatgggcctatttggcttgccgccgacagctctccctttttgaactactccgaaggccgtatctggctataacgcgacgaggcgaccatgacggacacacgacacacttccccagccgcaggtgccgcctgttcagcaccggtgcttgacattcgggatctcagcgtctcatttcgtgggcgcagtggtgagaaccaggcactgaaaggcatcagtttcgccattaatccgggagaaattgtcgccgtagtgggtgagagcggctcaggtaaatcagtcacttcgctggccgtgatgggcttgctggcgaacagcggccgtatcgatcgcggcagtatgcagtttcgcgatcgcggcgggaaagtgcatgcgctggaaacactggatgatgctcagcgccgcacgttgcgtggtcgtgaaatggcgatgatctttcaggagccaatgacctcgctgaatccggtgctgcgcatcgatgatcaactcactgaagccttacgcgatcatcaacagtacgacaagaaacaggcccatgcgcgcgtgcgtgaattgcttcaacaggtacgtatcgccgatgtggatcgtgtgatgaagagctatccgcacgcgctctccggcggtatgcgccagcgagtgatgattgcgcaggcactggcatgtgatccgcaacttcttattgccgatgaacccactacggcactggatgtcaccgtgcaggcgcgcattctgcatattctgcgtgatttgcaacgcgagaagcagatggccgttctgtttatcacccatgatatgggcgttgtggctgaaatcgcggatcgcgtcgtagtcatgctgcggggcgaagtggtcgagcagggcaccgtatcagagatttttgccgccccgcagcacgcgtacacaaaagcgctgctggcggccgtgccgaaactgggcgatatgcgcgactatgcgtggccgcaacgctttcccctgctcggtgcccggcacgcggcacaagacgagcagcataccgctcgctacgacagggcgccgctgttggatgtgcgcgggttgaaagtctactatcccatccgcagcggcattttctcgacccatacacatcatgtgcatgcggttgagcagattgatttcagcctgtggccgggtgaaaccctggcgatcgtgggtgaaagcggctgcggcaaatcgaccaccgggcgtgcgctgatgcgcctgatcaacagtgatgccgaaagcattcacttcgaaggaaaggaaatctcgcacctgaaagaggcggccttccagccgctgcgtcgtgaaattcagatggtgtttcaggacccttatgcctcactgaatccgcgcctgaccgtggggttcaccattgccgagccgttgctgttacatggcatggtgtcctcgctggagcaggcttcttcgcaaatcgatgcgttgctgaaaagtgtcggcctgttgcccgagcacgcgcgtcgttatccgcacgaattttctggcggccagcgccagcgtatcgccattgcccgcgcgatggcgctgaaaccgaaagtgattattgctgatgaagcggtatcggcccttgacgtctcgattcaggcacaggtggtcaatctgatgatggatctccagcagcaaaccggcgtggcatggattttcatttctcacgatatggcggtcgttgagcgtattgccaatcgcgtggcggtgatgtacctcggccagattgtggagcttgggccgcgccagtcggtatttaatcagccgcaacatccttatacccaacgtctgctggcctccgtgccggtagcggaccccgagaaccgtcagccccgtattttcgatgacagcgaaatcccttcgccgttgcgaaaggtgggtgaaacggtcactaaaccccgttatcggcaggttgcgccccagcactgggttgctgacggcattgcattgcgataatcctcaacgaccaggagattttatgaaaacactgtttcgccgtacttcgctcgccctcgcattgacgacgacgctggtcatgaccgcgcaggcccaggatctgcgtatttcaatgtatgccgatattacgggactggacccgcacgatacctccgataatgtcagctactcggtgcagagcggcatctttgagcgcctgttccagtttgatgcccacatgaagctgcagccctggctggcgaccggttatacctccaacgacagtgcaacggaatttacgctgacgctgcgtaaaggcgttacctttcaggatggtacgccgtttgatgccgacgccgtcaaagccaaccttgatcgcctcgccgaccagaaaaaagggctcaagcgcaacagcctgtacaaaatgatcgccaaggtcacggtgctggcacccgaccaggtcaaaatcgatctcaatcagtcgtttggtgcctttattaacacgctggcgcatccttctgcggtgatgtggagcccgtcgattctgaagcagtatccggacgaagctcaacttagactgcatccagtgggaaccggcccgtttaaatttgttaactggacacagggcaaagcggtgacgctggcgaagtatgacggttactggcagcagggatggccaaaagtcgatcatgtcattttctcacccagcccggaagatgccacacgggtggcagcgttaaaatcgggtcaggtggatgccatctggccgttgccttccgatctgatcgctgccgtgaagcaggacagcaaactttcgattcagcgcgatcccagcatttatctttattacatggcgattaacacgcagcacaagccgctggcggatgttcgtgtacgtcaggcaatcaactatgcaattgaccgtaatctgtggctgaaggtggcctttgccggtttgggcaaaccggccacatccgcgatgccggaaggggttcagttctatcagaaacaaaccgatccggattaccactatgcaccggacaaggctaaagcgttgctgaaagcggcgggctatcctgatggcctggaccttaagctctgggtcaccaatgccacggccagcgtgcgcgccgctcaggtgctgaaagcgcaactggccacggtgggcattcgtgccacggtgacaccaatggattcggggacgcgcaacgctaagctgtggggcgtacaggacccgaaaaaggcagagtttgacctctattatggcggctggtcgacgtccacaggcgatgccgactgggcgctgcgtccgctgtttgccacagaatcctgggtgcccacctcgtacaatgtctcttatttcagcaatcctgatgtcgataaagcgattgccgccgggctggcgacggccgatccggcaaagcgtggcattgcctatgcgcaagcgcagacgctgttatggaaggatgcaccagtggccttccttggcacacccgacaatctggttggcaaacgcagcaccctgaacggcgtttcgatgctgccggatggcaatttgctcttcactcaggcgtcgtttaaataagacgcggatcgccttcaggttctttgccctgtgcgggcaaggaacctgagggtgcctgtcgcacctcatttcaaggaatggcatgtttgcatacatcattcgccgattactggagatgatcccggttttgctggtggtctcgctgctggttttcggttttatcaagctgctgccgggcgacccggcacgcatctacgcgggaccggatgcgcccattgaggccgtcgaagcggcgcgacagcatctcgggctgaacgattctctgccgcagcagtatgtccactggatcgatagcctgttgcatggcgatctgggcacgacgtaccgaacccagcaaccggtgctgcaggtgattaagcagggcttcatgccaaccctgtggctggccttagcgggtttcgcctggtccgtgattctcggcctggtgctgggcgtgctggcggcactgaagcggggaaaatggcaagactggacgctgatgagcatggcggttggcggtatttccatgcccgctttttggttggggttgttgcttatccagttcgtcgcgatgccctttggggtgttttccgtcagcggctttaacaaggccagcgatattgtcctgcctgccattacgctgggggcttctgtggcggcggtaatggcgcggtttacccgctcggcctttcttgaagtggcgcaggaagattacgtgcgcaccgcaagagccaagggactacgtaaccgcctggtgacgtggaaacatgtgatgcgcaatgcactcatcccggtgattaccatgctgggtttgcagttcggttttctgctgggcggctccattgtcgtggaaagcgtcttcaactggccggggttaggctggctgttgattgagtcgatcaaggcgcaggatcaaccggttattcaggcgttggtgatgctgttcgtgttcgaatttattgtgattaatttgctggtcgatctgctgtatgcggtcgtcaatccggccattcgtctgcgacaggagccaagatgagtatgcaatcgctgactgaaaacccgcctcaggtcatccgttcgccgtggcgtgatttcctgcatgcctttgtgcgtaaccctctggcgctggtttcgggcggatttgtgctgctgctgatcctggtggcgatctttgccccctggctggcaccctgggacccgatggcaccggactggatggcgttatcgtcgccgcccagcgccgcacactggatgggaaccgacgaactggggcgcgacctgctcagtcgcattatctatggggcgcgaatctcactctatgttggcgtgttgtccgtgacgcttggcatgattgtcggggtcgtattgggtttactggcaggctattacggcggttgggttgatatgctgatcatgcgtggtgccgacgtgttgttcgcgttcccaggcatgttgctggccattgcggtggtggcgcttcttggtacgggcctgaacaatgtgattatcgcggtcgcggtatttagcgttcccgtgtttgcccgtattgtacgtgcttcaacgctctcattaagacaggctgcctatgttgaagccgtgcgctgtgccggtgcaccagacagaatcattatcctgcgccatattctgcccggcacgctttccagcgtgattgtctatttcactatgcgcattggcaccagtatcctcaccgcggcgggcttaagctttattggccttgggccggaaccggatgtccctgaatggggtaatattctggcaatgagccgtagcatgatgatggcgggcgcatggcacatgagcgtgtttccgggactggcgatttttatcaccgtgctggcgtttaacctgctcggagacgcgctgcgcgacacgctcgacccgaaactcaagggctaaccatggattttcaacaattgcagtgcgatctgctgctggatcgctggcgtaatgcgcgaacgttagggcagccgcgcagcgcatgtgggcccaccaatcgaatcagcgatgttgctggtgtgcgcgttggacattacacgctgaatgacggagagaggcagactggcgtaacggctatcgtaccgccgggcgacaatctgtttctcacgccgttgccatgcggggccgacgtcctgaacggctttgcgaaaccggtcgggctggtccaggtcgaagagcttggcgtgttgcagacgccgattttgctcagtaacacgctggcagtgggcaccctgtttaccacgctggtacgggatgccatcagtcgtaatccggagctggggcggacgttacccacggtgaatcccctggcgctggagtgcaacgatggctggctcaatgatatccaggcgctggccatcagcgaggcgatggcgcaggaagcactgcacaaggctgcggccgactttgcgcgcggcagcgtcggtgcagggcgcggaatgagctgttttaaccttaagggcgggattggcacggcctcgcgtgttattccgtcgctcaacgcaacgctcggggtgctggtgctggcgaattttggcacgcttagcgcactcacgcttgacggtgtgcggctgggtgaaaggattgcgccgctaatggcgggtgacgcaccgcagcgtgatgccggttctgtcattgtgattatggccacggatgcgccgctggatgcgcgccagttgaagcgcatcgcgaagcgtgccggtgccggtcttggacggctgggcagttactggggccatggttcgggtgatattgcgctggcattttcaacgcaccctctgccgcaaccgccgcaggacgacacgctggagccgctgcttgccgccgccgccgatgcaaccgaacaggctgtactggatgcgttgttgagcgcggaggctgttaccggctttcgtggtcaccatcgcccctcactgactcagattctggacaaattaaccgcatgaaaatttttatctctgctgatattgaaggtattgcgggcgtgatgcgcccggagcaatgcacgccaggcaacccggaatatcagttggcccggggactgatggaacaggaagtgaatgctgcgattgagggcgcgttcgcggggggcgcaacggaggtggtggtcgccgacagccatgcgcaaatgaccaatctgcgtgcggaaaatattgacccgcgcgcccgactggtgcagggcaaacctcgcggcctttcgatggttgaagggatagagcagcaaaccttcgatggattatttctggtgggctatcacagcgcggcaggcgaatctggcgtactggcgcacaccattaatggccgtgcattctggcgtatccatatcaatggcctggtgatgggggaaaccgacatttatgccgccgccgccgccgagcatggcacaccactgttgctggtcacgggcgacgatcagctccagcactggatagcagaattttatcccacggttgattatgtctgtgtaaaacgcgctatttcccatacctgcgcggagtccatcagtcccaaagcggcacaacgtgcgatatgcgccgctgcaagcgctgcgctgcaacagcaaccttcggtcagcacgacgcgcctgacggcaccttattgcatgcagcttcaggccagcaaacccgtattggccgatctgtttagcctgattccgggcgttacgcgcattgatgcggtgactgtggaatatcaggcggagcgaatggatacggtgatcagcctgctcagcgcgttttcttatctggcgagtacccaatcctagagaaggatgttcgtgacgtcagggcagagacgatgttcgtccctctggcggtcacctggactgtttcctgcaaccccacggtctggcgaccgccaggccgtgcctgctaatcacgcgcacacgcggatgaccgccgggtcagccgcgctgcagcacaacagcgcctgaacaccgttgctcccgccatgcgcctttcgttgcaccctcatggtgcgaatacctgtcctgccagattgccaacacgggtgcggtcggccgggatgggcaaaaaccggcccggtctggctccctttcccgattattttccgcgcatacaggcaacatcaccccgatcggcagctaaacgccacagtgggcggcttcgccagcgttacggtacaatttttgcaataaagcaggaatagagcagggattgccatgccgcgatcacgacacatttgcttgcgcgccatccagggcagggaacggagaaccgcgtaacagagcgcgccggtccggtttaccggtaggcctgacgagataaacgatgttacaggtgtacactgtgattcagacattggcggttctgcgcgcgaacagctaataaaggcttctgacaacggcctgcgggcagatgaatccacttagggtaaataatgatgcggctccgccacatagaagtctttcaggccatcgttcagaccggcagcattagcgcagccgcgcgcttgctcaatgtgtcgcaaccgaatgtcagccgggtgctgaatcacgcggaacagcaactgggatttgcgctgttcgaacggcgtatacagggcatgagcgtcactgcagaagggcgacggctgctgccggaggtggaagatctctaccaacgcttacaatccatcacccaactcaccgaacaactgcggcgcggcgaaggacagacagtccgcgtcggtgcagctcacgcttttggtcaaatggtgctggctcccgccctggtgacctggcggcaacaggtggcctcggtcagtgtcgaactggtcacggagcactttaataccctgtgccagatgattctggataatcagctggatttcgcgctggtctttggtcagcaggtggacgccgatctgctggccgaaccgctgtttcagtcttcgatggtggcgctgctgccacttaatcatccccagcacgagcccgttacgctggaatggttatgcagtaataacctgctgatgatgcagacacaggacccgcttgggcgcgtcctgcaccgtgcgctgcgcgataaaaaactgaatccagccgtgtcgctgtcgattaaaacctactcggtgattgcggatatggtactggcgggcggcggcgtgggtgtcgtggatctgttcacggcttgccgttatgccgaccagttaaaattactccctgtcgcacaaccgttgccgtttgaagtcatgctgatcagccgtcgagatcgcccccaatcgcagtccacgctgcaacttaagcaggtcattcgtaacagactgtgggagattgcccgccagtgcgaagcgcagtttatccgtgagtgagcaagctatgcgctcacttacagccatgcagcttattgaaaatactgttgtagagctttttaaaaaggtcaggaggaaggtcggtatcctgagatttattctgtctgggggatcgcgctgttcgcgctataagcatattcaaggcgcgcacctgagcgttttttacaagggtacggcaatgtaaacctgcgccgggttgtaaatggatgaggttactatcctgagaaatgttaaaagccctgaccattgcagtcagggcttttaaggtacttcagacttcagatttgacattaatgaacttactaaatgactactgcaatttatactgcgtataaatgcacccgtttgctacagataatattgggcattaaaacgtgaagacctcccattagttatcctggtatatcacttgccatctttattaatgactaaagcatggcgtcttaaacaagtacattccccatcgcgacatatactctttgatgcgttgcctgactacagttgccttcacctgaacccagggaagcaacgagatggttaaatcaaggccttacatcgtcgcgcttttactaccattttgctgcacagcactgtcactacgtggccttaaagcgaactgcatcccaaactacagacttcatggcctttaatgcaaaatggcttaccccaattagtacaacaatgatgctcgtttctctgtgctgttaggaacctaatctacgggttttattctccgagtcaatactgtttttaaaaacatgtttaaattatcagtgacatagaaaatctccctttaagaatgctcccaatattttatttctgtgggccagagcgaacgtcagtgaaaaatggccgatgcttttttgacatcaatcaaattcatttagaagcctgcattccagtgcatcgctcattattttcttcagccggggaattagcgcctttcattgacatcggttaaggacgaaataagaaagttatattgcgtatctggaaaaatatatggaaaaatcatcatcatgaaaacggtactggtcgtagcctggaaacaggagcagggcagaatgacccgattcgggtgccggtggtttttcgcccgtggaaagcgccagcgagctgaatgctcagctgtcaaagggtaacagcagtacagcgttttgttaatacggagactgttgttggcagtgagcgactcagtcaggcttcattccgtgctcccggcgtgtgatgaagcggccagacgatgtggtttctggctcacagtatcccgaactctctctgccgggcgttaggtaacccggcgaacaatttgacaggtgtagaagaggtcataatgagtcaggttgaaagggtaaatcctgttaaagagcccctgtggcgaaaggtattcaggatctacatgatgacgtgttttccctgcgcgttgttaatcactttaccttcagtattcattatcccgtcactgctcaggaaaggtgattatctgacgctgtcgcttttcgttgccatctgggttgcctttgccgtgccgctgatttcagccggattaagcaaattacgccaccgtaaagtgctcggccacatggttgcgcttctgagttgtccccatcgtttcagcccacgcgcgcatcaggtggtagatacaaaacgaggtcagtattttggcgtggacaccgatcgcggcaccctgctttacattcacagggtgaacagggacaccactgatgtggtggcgctgaccatggaggactgggtgaaatgtgaacaggacggggcatgtttacgtatccacacctgccggtcggatgtatcaccactgtgcgtatacgatcatccttcatcagtgggattgatagccgaaacgctcagggcaatgagacacagacgttatcccgagcctgccggagaatcctggtctcactatgtcaggcggcagagtcgcctgattccttatgcgcacaatgttatcgcacctcaggacatctgattcctccggctggctgctcgtctggcctggtcatgaaaatcggttactgttctggacagcttcgtgccgcttacggggtgatggcgcatacccgagagataccgctttataaagcgatctttgttaatcctgcctgggacggtaagggcggcggtgaggaaaacaaggacacgagtagggcaggacattaccagatgacgggatggggaatggcgtgaatgttacctacaggattgcctgctaaatgatgaccgcggggacaagcagaacagagggcggacgacatcaaggcaataaaaaacccgcacaaggcgggtttttttgttatcggcagagctgttctgagcagaccagtgtctttctcgcggttgtcagcgccgctgataacgaaggcaggttagagcggcgtaacgttgccagctgcaggacctttagcgccattttcaatggtgaaggaaactttctgtccttcatcaagcgttttgtagttatcactctggatagcagaaaagtgtacgaatacatctttgctaccgtcgtctggagtaatgaagccaaaacctttatctgagttgaaccattttactaaaccagtcattttgttagacatagatatttccttaattgatgagccactaggtgcggcggttatggcctgtcattgagatttacttattgggcacttaggaggaggctctcgaagaaaggtatctttggataacgctttaactgaggactgctttactaaaactgcttcataaggtctgtgttccaaaccgatgcgctattaagacacagcgaaattgattttgcaaaccctttatttttctgtctatttgaacgttcagaaggctgaacggctatccgaaacgcgctgctggaagagagtgaggaatctcagagacgctggctgtttttgctaaagtccacgaaaggttaggaatcggggacgttctcttaagacgctgccagtcggaaactctcattaagcgtgtgaaacgaaaaattatggtggattgcaggagtgataatgaagggcgtcagaggcttatgacactgggtgagatagcgttggcaagatcggttttagtccttccatcgtttatcctcgcgtctggattcatcatgccagtgactttcccttcaaacttcagggaagaaataccacaatgagtcctgacggcgagctttatttccgggactggtattgcgaagacgttgtatcagcactgacgtataataagcaggtcattttcccggctgaaaaacaaccaaaagcaggtcttttttgtattcagccagcaaaatttagatttgaaaacgggcaagaatatttcacttatattgaagtaaataaaaagcagaggatgagaatataaaggctacaagaaaagcctatgtctcgaccttccgggtggtagagcgagataacaatctcaagattgttccaaccgcgcataaatcaaagccaaacccgcatccctgtattcggggtaatttacagtgaaactgtacatgacagagacaaaatcaaacgcaattccggcaacaaaaagttgccgttctgaaaggtgataaggcgcaagagcccgacctgaaagcgttgcggtttgagtcaacagtcatatctgtagataaaggtatcgtcaatcctccccaggccatcgaggcgctcgttcacgagagtggcttcacgtttgaaaccacatttcaacgcaaccgactgactgcgcaggttacgtcctgccgtacgaatttcgattctctttgcctgcaaaaatgctgaggctatgtttgtgacctgtttgcatgcttcagacattatgcctttacccaacacatcggtagcgagccagtagccgatttcatagtaaggaatcgcgcgatttctgatgaataagctaatacagcccacgagttcatctgactgacgatcaataattaaaaatttatattcttctctgtcattcagaaaattatcagccgcctccgccatgtttttcttaacagaatcaagagaatgaaatcccggagaccagagcaagaattcatgatgaagagaactgaacgcattcagtttctgctgcatttcttctgtacggctcatgtcaggggcaatcagataaaaattttcatgctgcagaaaatgtaaaggaatatcatccagatacatattaaatctcccgtgcacaggttatttttatttcttatcacaagcgaggaacagcggcatccacttttcaggatgtggtgagcagcaaacttccccctccagcccgcgataagccgaacggcgctcgcactccagcatcagcaaaacccactcatctcccctgcatgttgagtccacctcgtacaccatcatgccgtttccacatccgggcgagatccccatccccatgaatgttatataactgtaagtattaatcgaataaagttgctacctggcgcgtttatgcgttgtctgttcactggagaatcccgttatgacgcgcgctgttacttttctggttgctgggttgctgctgagtccgttatcccacgccgcctcactttattacacgatttccacccctgacaccgcgatagggctgtcatggcgcgcctttggcggtatttcacatgcgaaattaacgggcgtgaccggcgaggtcgcgctgaatccgacgaatgaaatggataatcatgtgaaggtcagtattccggtctccacgctgattgcctcaaacaatctgctgacctaccaactgaaaagcagcatgttttttgatgcgccgcgctatcccaatatcgtttttaccagcagccggatcgtggcgcagggcaacggccatttcagaatttttggttcgttatcggtcaaggacgtgcagcggccggtgattctggaggccacgatggaaaagcacgatcgcactgcgcagagcgaggacaggatatcgctacatgcgatgaccacgatttcccgttcggcctaccatatggatcgttttaccgcgctggtggatgatacggtgaccatcaatattgatatccaggcagaggccagccacgtgccgtgaaacggcgttacagccagcaaggccgctggccgttaagcgttgagggattttttcagggcgtcagcactggcggccagttccccgtccgggttgcggcctatcagaacaaactggtagccgccgtgatgccaccagaccaggcgcatatcatggcgttgctcacgctgcaggccgcccgtggcaggctgctcgtccggggaaatgcacagcgccatcgggccgtattccgcatgaatccacgcaatctgtgcaatggacgtgctgtcatagcgcagcatgcgcaccatctttaattccgcatccggcaaggcaagctgccgggcatgaagacgcaggccaatgtcctgcgccgttcgcgccagtccatgctgcagcgcggcaggggagttatccgcatccagcagggtttctgcgctgtacagtgacatgtactgcgcttcgagatcgcgaattttctcgctctcactcagcctggttttagccgggcgagcaaggtagcccaggcccgatccgatcaccagaaaactcagcgaggccgcaatcagcgaacgacggctgacgcccgatgtggcggcaacggcagcagcagcgggttcctgccttggcgcggctaatagcgtgtcgagctggcgctgcagtttggcttccggtgccttatccagtaagggcgcaaaggccgcgtcaaagtcgagctggcttttcatcagttcatcaacgcgttcagccagctccgcatcgttttccagcagcgacgcaaactggcgtgcatcctcggggtccatctcgccatccagccaggcgactaaggcttcgtcactgtaagggggcgaaaaatgcagcctgttcatgagcgtttctccttcgcagcggcctgagcatcaaatgattttgccagcgccgaacgcgcggttgccagcctgctcataatggtgccgatgggcacggccagcgtctctgcggcttcctgataggtaaatccttcgacatacactaaaaatatggtattgcgctgggcttctggcaatgcgctgacgcgctgcatgattttctgaaaatgcaggcgttcatcgtcacgttcctgcgtatcaggggccagcaggtcatcgctttccacaaaaccctgtcctaaccgcacgcggcgggcgcgtagatcggaaatccagatggagtgaagaatcgagaacagccagcgatctatccgggtacctggcgtaaactgcgcgctcttttcgagcgcgcgaacacaggtagactgcacgagttcttcggcaacgtcgtggtttcgggacagcaccagcccgtagcgccacaggcgcgtcagatgggcagcaagctgctgacgaacttcgctggtagtgatgtgactgtcctcatggtacgtatcaggattccggatggccatcaatggcggcctgcaaatcacgatactcttcgcatcctgtaccgcacaggctggcgatggttttcaactgcgcttttgccagatcgggacggcctttaatcagccacgcctcgcccaggtattcgcgcactttcgcatagcgcgggttaagcgccagcgagcgttgataatacccgataccttcgtcggtacgcccgagttttcgggtggcataaccccggtaattccaggcttctgcggtattgggctgtttcaggctatccagcagcgtcagtgcggcctgatattcgcctttttttgccagatgataggcatagttggtcttgtcttcgtcactcaggcgtgccgtcttgtcgggaacgcactgtttactcttgctgtcgtaaacctgcccacgcggacagtcgggaatgttactgttggtgctgtcatcgcctgcggccagggccgggttggcgtggataacaaacagcagggccggaaccagcagcttacggcctgtggcacgcagcagtgaagaggtgtttttcatggtagtgctccagttaacggtaggtgcgaacgggcagcatgcggcgcagcacgttatcgcgtaaaatgtagtggtggataagggcggccagcgcatggaacgaggccagaataatcagcgcccaggcgacattgttgtgtaattcccccagggcatgtttgagcaggggatcgacatgcaccagcccggtcagatcgaacaggccaaaaaaaccaaagggttcctgctgcgcccagcgaaacataaagcccaatacaatttgtgtgaacagcagcagatagagcgcaccgtgcacgcagtgtgaaaggaattttaccggacgagaaatggccgcggcaggcatcgcgtaacgcggtgagcgttgactcatcagccgccagaccggccggaccaccatcaccagtgccaggatgatcccgcaggaaatatgcaccgactgtaatcccttgcggagcggtgtcccgcgctccagccattcccagatgtgcgcactggcaaacaaaaagatgacgctggcagcggtaatccagtgcagcgccagggtcatgctgtcgtagcgctgtcggggttttttggcttgtgtttgaatcatggcttgcgatctctcagtcaggtttatgatgagtgaacgtatctgtgcggatttttattcgatatttttttaacgcgctgcgtttgggtgaggtcactcaccagaggaagggcaagaaaacggctgaactgcccggcctgcaatcgttacccatttcagtacacgtcgtgccatgcgccgtcacaggtatgttctggttgccggtgagctattcgaatgatgcgcatcctgcgaaaggacattgacgtcatcgggagggtgttttaatgatgtagggcagttatcacccggttgttaaaagccaaatccactcttaaggcgcgttcccatgacgatacaggtttgcattcccgatgattatcagctggtcacgacgggcctcgactgcctgcaaaaccttccccaatttcactgcactgccgttggggatatcagccgggattctggcgcggatgacgcgctggcaagcgcccaggccttgatcctgatccgtgagcgcaccaccgtcgacgacgcctttttacagcgcacgccaaatctgaaactcatcagccagaccggcaaaatcgcccgcaatatcgatctcgcagcctgttcacgggctggcgttgccgtggtagaaggcgtgggttcgcccgttgccccggcggagctgacatggctgttgatcatggcggcccgcagaaagttcgtgcaggccgttaacgccatgcgcgccgggcactggcaggcggaactggggcagggcgtgcacaatcagaggttagggattttgggctacggaaaaatcggcaagcgcattgcggcttacgctaacgcctttggtatgcaggtgcaggtctggggcagcgatcgcgccaggcaggaagcgcagcaggagggattgatcgtgcctgccagccgtgaggcgttttttgcgaccagcgatgtgataaccgttcatcagcgcttagtggcagaaactcagggcaacgttacgctcgtcgatctgttgcagatgaagcccgatgcgctgtttgtgaacaccagccgggcagagctggtggccgccgatgcgttgctgagtgcgctccagcagggccatccgggctttgcggcgcttgatgtctttgaggcggagccgatttacgacccggcgcatccgttattatcgatgtccaatgtgctctgcacgccgcatatcggctatgtcgagaaggacagttacaggctgtatttcaaaaccgcgttcgacaacgtggtgcgcttttttgagggtgatacaagccatgtgatcaacccggatgtgcggggataagcttatccttagcgctgagggtgctttcaggcactcaagattaaggcgcgccaccagcggacaggtggcgcaaataacatgagctattctgtcataacagttatccacgcgtgatcggaataggccatcttcgacttgatagctaatggattcgatatgcaataaacattttttgctggatttttaacaaaccacatctttatctgctcataatgataataaagttgatgagataaagtgattaaatatcctgttcatgacttctctggaaatatcctcttagtacatcaaagtaatacaattccccggaaaaaatctttttcaggctggatcgtgtcttgatctttataagcgtgattcaacctgtgtccacataatgatgtgagttatcaacctgctaaacaggagcgagagtgggctgcatgaatgtcaattgtgtgatgcgcctctaaaaaaaaggcttttagcccaggcagttaccagattctaatggtgatggtctgtgtggagttggcaaatcggcgatgataaagttattaagataaacataattattataaaggggatggtatgtacagtaaattatcggtcctttttaatgaaatgattgaccaggattttcatacagcacgcgatctggctggccggctaaacgtcagtgaaaaaacagtgcggacccgattaaaagagttgaatgccattctgatgtcgcatggagccttaattcattccaaatccagcatgggctatcagctggtagttgaaaaaaaagatgattttcatcgtctgacgatctctctaaataaaaacagccacgtgcagcggccaaccacctcaaatgaaagagtcgtttttattctggctaacctgctgagtcgggatgactatattaaattagatgagctttgcgacacctattacgtttcccgtaatacaatgacggcggaccttaaaaaagtcgagtacatcctgcatctgcatcaactggtacttgatcgtcggccgaactatgggattgcggttcagggtgatgaattcgataaacgtgtttgtatcgccaataacctcatccgatttaatggttttatgaacgaggatggggaaaaagagcagggcctgaaaaagatcggcatgattattttggctgttttacatcgctatgggttgagcatatccgaagtctcgctggaaaatcttgtttcacatgtttttattgcggtgtaccgaaccaagcacgcgcactccatatctgtcgataccaaaaaaatacgcatgctggttaaacctgacgttcttgaggcaacaagactcatcgtacaacaggtcgaggatgcgcttaacctcccactgaatgacaacgaattctcatatattgccctgcatatgggcgctaagctgtcttccacagcggttaaaaaaaccggcgtcaatatcgttatctcacgaaagatcgacgagttgaccgggcgaatgctggaaatcctgttcaagagtttcaaaattgatttcatggataatctggagctgcgtatgtcgttaaatcaacatttggttccgctggatatccgcatacagtacggcatcccactcagtaatccgctggtgcaggaaataaaaaaagagtatgccttcgcctataccctggcggccacagcctgtattgcactggcagaacattatgccacccgtattcctgatgatgagattgcttattttgccatcatctttgaactggcgctgatgaaaaaagataaaaaagtagagaagaaaaatatcattgtcgtctgtgcgtcaggaaaaggcactacacagttatttatgtacaaatacaaacaggcattcggaaaatacgttgaccatatttatgaatgtacggcctgggagctggagagttttgactttgcaggaaagaacattgattacattttcactaccgttcccgttaatacagacgtgccggtacctgtgtttgaagtgacgcagtttctggaaagcaaagatatcgcaacctgtaatgaagtatttgaaaacaacaacaacgtttttttgtataaatactatcggcccgaactgtttgtcaccaatatcaatgcatccacaaaagaagaagccctcacaatattatgccagcacacggcacaaaccttttcgctgccagacggcttttacgatgcggtgataaaacgggaagcattggggcaaaccgactttggtaatctggtggccattccgcatccattccaggtgatgacccaaaatagctttgtcactatcgggatattagaacgccctatatggtgggggcacaacgatgtgcaggtgatattccttatctccatttctgccgatgaggacagcgatgtcggccgtttttatcaactgacaacgaagttcctgtttgactctgctgcgatacagcaactgcttattaacccgacgtttgacgtcatcatgaaattgcttaaaggaggtgaatctctataagcgaaggcaaattttaccactttcaacatggtaaatttcccgctggagagaggagaaagtgatgactatgatgacggtaaatgatcagaaaacggaacggtaacgtgatggaaattagtcttgaagatattatcactgaattagtcgttaacggcggcagtgctaaaagtaaagccatgcaggccatgaaggctgccaggttgggtgattttgaactggcagaacagcgaataaaagaagccaatgactttttacacaaggctcaccattttcagacggaaatgattcaggcagaagcacgcgaagagaacccgtgcgccgtttcgctcattatggtccatggtcaggatcatttaatgagcgcgatgacaacacgagacatagccatcgaaatgattgaaatgtacaagctgatcaaaaataaataacgataaggaaatagccatgatctacatcacattagtttgcgcagctggaatgtcgacctctatgttgatggcaaagatgcagcagagtgctaaacagcgccaaatcgacgtgagcattattgcgatgcccgaagaaaaatttaaaacgcataatgggaaaacagacgtacttcttctggggccacaaatatcttatctggaagatgacctgcgcgaaaaatatgaacctcagggcattagtgttgccgtagtcgatatggtggactatggaatgatgaatggtgaaaaagttctggaagacgcgctcgcattagtaaagtaaaccgcttattaaacatcaggtgcatagccaaataaacgtggcaggggattattatgcctaaatttgaccgaaaagcgataaccaataaaattaaccccgtagtcaataaaatccagaccagtaaactggtcaatggcattacaggcggcatgatgagtgccatgccaattacgatactgggcgcatttgcagcactgttcctgaatttacccattccggcctataaagcctttattgccagtatggggattgccaccgcgctaaaaacgatcattatgtttaccacaaacttccttgctgtgatattcggcgtcgccattgcgggaagttatgcaaagcaacatgacgaagatgcgttattctgcggaatactggcgttgctaagtttctttatcgtgacgcccgtagccctctccgaaaccggtttgcccattattcctgtgcaatggttaggcggaacgggcatatttaccgccatcgtggtcagcttgctttcaacccgggtctacatctttatcaagcggcaagggttcactattaagatgcctgccagcgtgccgccggtggtttccagcagtttcagtagcctgatccccgggttcgcttcattaatcttgtttgctgccgtgtcggtcatctttactgcgacaccgttcaaaaacatgcaccagtttatctataccttcctgcaaattccacttcagggcatgggaggaaatattgtctccatcatcctgctctggacgctggcgcagttactgtggtttgtcggaatccacggcaccatggtcatttactccgtcgtgttaccgatttttactgcaatggatgcgatgcaactggccgcctattctgccggtgagtcattgccgaacatcaccgggcgagcgtttgtcagtacctataccatgtcgggcagtgcgattggtctgacattgctgatgttgttctttgccagaagtcagcaatataaaacgctgggtaaactcaccacggttcccgcgctgtttggcatcagtgaacccctggtgtttggcacgccgatggtatttaacttccggtttgctattccctttatctttatgaacgccatcagtctggtgattgcctatggcgcaacctatatcggtcttgtgccgcgggttgccggaattacaccgataacgggcgtgcccattatattaagcggtattatggaagggagctggaagatagcggtattgcaggttgtgctggtcgccgtgcagttaattatctggtatccctttttcaaaaaggctgatagagcgtcttaccgccttgaaaaagaaggcacaggcaaacaggtttaatgattaaaaatacgcttgcctgataaataagattctgagggcggttattcgatggagttgcccgttttaaacagaaccgtaaacaggaatagcctgtcgatgtaatcaattaatttataacttaatcctacttctgctctttacaaagaaaactattatggaaattaaaaaactcaccatggcggtattgttattggtattgacttcacctttactccaggccgcagaaattaacgataatgaagatgcgttacgtatccgactaaaaaatgattttcgccgtgcggatcggcccagtgcggggaactacgaaaaaaacatttatggctgggttcagggggccatgattgatgcaaattcgcactattattctgatttcattggtatcgaagcgggagcatattatgtttataagctcggtgccaaagaacaatggagtacacgcggctatctggccgaccatgacagttttggcctggtgacgggagcaataaagttaaaacctcaggataatattcatcttaaaatcggtcgcttcggtactgataacggctatggcagtttgccctaccgcattccatttattgcttctggctccacccgaaccatgccaacgctttcggaaggtgtattaggtcgctatcagcctgacgacaatatcgatctatgggcaatgtatcgcacacgtgtttttctctggcccgatgcggcagtcgggatgcgtaatgaagggatctacaacgcgtccacaggccgttacgataccaaacgggcacgttcttttctggccggtagctggcacgataaaaacagccgttactcccttggcggttcgtggcaggacgatgcttcttctcagtatcaggcattgatagaaaagaaatttccgcttgaaaacaaaaacgcgattaaagtcgaactgctggcgtttcatgcgctgttaaatggcgtgtcacgtactcagagctatcacaataatactcaggtttattcaggtcagattacctacagcatgccaaaaataagtttttttggcgcggcgggaatcgttacccatgcgatgaatggtattggctctaatgttgatactgatatcggctatcccaattccctcagtatcgacagaaataaagaagacatgttttccttgcaggtgggtgcacaatatttctttcggccaaatctgagcgttatgcttgcacctctgattacacgcggttacgaagatacaagacgaaccattcggatgaatggtcggggaattctcgcgggtattttctataacatacaagaagggccgttatcaggaatgaaaatgtacgtcgcgtcggatattgctaaggagaaaagggagggtagttcgctggggaataacctctattactgggatgttaaagccggaatacagtacgacttcatgctgaaataattattctcacctctataacgaaaagaaggaaggcctgatgttaaaaccgattgaaacgacgtcacgtgaagctaaattactggatggtttatgggaatttaaacttgatgcagacaggcgcggattaaccgataagtggtggaaaagccgactcagcgctgcgcgtaaagtggcggttcctggcagctataacgatcaactcgccgatgaagccgtacgctcgcatgtaggcgatgtctggtaccagactgaggttcgtattcctgagcgctggcatgagcaacgcgtggtgctgcgttttgatgctgtcacgcatcgtggaacggtatggctcgacgacgaacaaatcatgttccatcagggcggttacacgccattcgaatgcgatatcactgcccacatagcggcgaaacgcactctacgccttacggtttgtgtgaacaatgaactgtcgtggcacaccatcccgcccggcattgtggtcgagcaggaggggcggctgaagcagcactactttcatgacttctttaactatgcaggcattcaccggcacgtctggctttataccacgccgcgtgagtttatccgggacatcgaggtgcacacggatttcagtgatgaccttcagtcaggtgcggtgcactaccgcattgacgctccgggtaacgtgacctgtcagttaagggatcatgagggatcgcaggttgctcagtgcacggggcgtgagggatgccttgaggtgattcagcctgtactctggcaacccggcaaggcttacctgtaccggttgatcgtgaatgcaggcaccgactgttatgaactgccggtgggcattcgtactgtcgaagtaaagggagatcagttccttatcaacaatcagcccttttacttcaagggatttggccgccatgaagatgccgatctgcgcggtaagggcttcgataatgtgctgctggtgcacgatcatgcgttgatgtcctggacaggggccaactcttaccgcactgcacattatccttatgcagaagaaatgctggactgggcagatgagcacggcatcgtggtgattaatgaaaccccagcggtcgggtttaacgtttctctgccgatgattcgcaacattgcccgaccagaaaaactgttttgcgccgaggcgcttaacgaggtaacgcagcaggcgcatcttgacgcgatacacgaactgattgaccgggataaaaatcatccttcagtagtgatgtggagtatcgcgaatgagccagacgcacgtgaacccgccagcagagagtatttcctgccattggtggaggcgacaaaactacgggatgccagccgtccggtttgctgcgttaacattacgaaatcctcgctggatgaagaccagatcagtgatctgtttgatgtgctctgcctgaatcggtattacggctggtatgaaaatcccgctgatctgacggcagcggaaaaagcgctggaaggggaacttaccgcctggcacgatcgacatcaaaagcccatcatcattaccgaatacggaactgatacgttgtcgggccttcattctgtttataacgaaatgtggtctgaagagtaccagtgcgcgtttcttgatatgtaccatagcgtttttgatcgcttaccctttgttgtgggtgagcatgtgtggaactttgccgatttcgctacctcgcagggcatcattcgggtagggggaaataaaaagggcgtatttacccgagacagaaaacctaaggcatccgcttttctacttagaaagcgctggacggcgatgccttaaccggcgtgcgtgagaacctggatgcgcgaaagtgcatccaggcaggtgacaggtgcagacgttatcagcgcagctaactgatgaagagacagaatcggtttttatggctgtttttgcgggatggacagggcttagctgccatatttttaacttaaataaaacctatcttaaatcaaactatgataagaggattaaattattttaagaaaggctttttgttgctggttaaactaataaaacgttttagttatacatgttgatattttttatgtggcttgagtgttatctgtatcaataaatccgctctgtgagatgcgttccttttttttatagtctggcttatccgcttatccgcttatccgcttatccgcttatccgcttatccgcttaaatatcgacagcctactgatccaccaagaaaaaggtgcttatgattttaatgccagagcgcagacctcatggaatgatttccattgccttaggcatcggattcacgtttactgaatcggcagccatttatcggcacaatttttgacgcactaccacaagccactcaacctcgataataaggcataaaaatgaagatggaaaacatcccctttgggataaccgactggtcacagatcgaggaagaacggcatccgggggaaagcggattcgcgctctggcgcgtggcaacgtttggcgatatccgggtcagaatggtcgagtattcccccggctacgtcgccgatcactggtgtatcaaagggcatattcttctgtgtctgaaaggggagctggtgacagagctggatgacggacggacgtttgtattaacgcccggcgtgagttatcaggttgccgacgatgctgaagcacatcgttcaacgaccacggcgggagcaacgctgtttattgttgactgatgggattggtagccttattgcgggtgggatggatttttcatgcgatagggagattgaagcgcggtatcgtagattaacttgttggggaagggtgctttctgatgagaaaggcaccagggcggcctgataagcgtaagtttagtgaggtggggcttaatgtcgtcgcttaccgttcagaacgtaaatatgcggacctgccgtgaaatcagtgagtccaccaggggtaattttagtcaatgttcaataaagcgtgtttttcagcctgtccggcaaggccttatcgtatgcatctccatcgatttctgattgtgaaatcatcttcagaatagtgccagtgctgggtagggttttcctgtcaatctgaatggcaggatcccataatttcgagcggatgatagccctactgcattgaaacattacactctgtactgaaatacgtaacacagttttaggcaactggcctttcatttcaaatttttccagtagggttgggtctatagagatctcagcagtgccgtttaaacgtatcgtttctccaattcccggcaccaggaagagaagcgctactctgttgtctgttaaaatattacgcagactgtcaagacgattattaccccggcggtcaggcagaaaaacggttttcgcatcatgaatatgcataaagccggccggatcacctcttggggatatatccagcccatgaggccctgaagttgcaaggacgacaaaagaggatgcctctataaaagggcggtatgcctgatgaatatgatcagtaactttcattaaggaaggtttggctacagcgtcgtaaagcttgtccaactcaaaagtatctcttactaccatgtctttataaatcatcctaaagctcctttcattcaaaatgacaaatttgcacgagttctatgaataaaacatgacggatgagccagaaatacgatctgcctggtttgaatcagccaaaacctctctgatgtaatgtatatgcctaaagcacgctggcgttgcatagtcatattacttaggtgatgctcgcttctggcactcagcggacatcagatagctccaggtggccctccgctgtgagcggaaagcgggcaatcagcgtcaaaagctactttttttactgcaccttctctatggtatgaaacgatgattagccaggtcctgagtccggacctgacggcaataagtttgatcatttacacgaggttcgatacttgctatatcttatctcacatcggcgtgcactctggcctctctagtcatttcaagcgcttatagagggtattttaatgaatcagacccactctgttccggaaatttataatcctgaagtgccctatgcagtaaaatgcgagatagtgacacaactgtgccgggcactggcttcccataaaaatatctctccagaggatttgagaaagtatcttctggagaaaacgcatgttgatttcgaaaatctcgaaggtaatccggtaggcatgctgctgctgtatgagtacctttactctcagcgccccacagcttgcgccagcgctaaagaaagcctccattaagagcagcctccagcagggggctaatcggtcctgtcaccccgcgcgcgaacgccagtcgtagcgttatcaaaattcacaactaccttgtgcactcctggcacgaagcagacgagcggactaagcagaaggtccgctatgagcaagaagcgcatattgctcaaatcgggatgtgctcatcggcgggggctggtcagccctgtaagattctaacctgtgccggaacaaattcgtctgagtctggtgacgttatttatgctcattgtcttctgcatcaccggtccggcaggcgccgggctgcctctgaaaggtgaagtgagtatttaagccggatagcctttaaggcagaaaaatctcaaaatggcagcggtctggctgaactcggcgggccgtcctgccataacctgtggccagggcatcagctcagcgcataagccatttgcagagcgtaaaaatcctgaataatcaatagggttttgtcatacagatgtgtaccaggcacagatgtacctgacttcagtccgtgttaattaacggtgcagggttcctgacagtgggttatttactcaaaatgacgggcatgcataacagttgccttaaaaagcgtaattcgattatttacatactcagagataaaaagcgcataaaccgaaaatttgaaggtatgtttgtagcaatcgcgcaggtgccgacaggtagagccataggtggtgtcatgaagcctggtactggctaaggctaaacagaagtgaattaacggtagtctttatgcttcaggctaaagttttacaaaattgtttctcgatatcaggtgagcgaggccgatactcattttacaggcaggatcatctccgagcaggtcgatgaactcatcaaggacagccgcatgaaatccgtaaccaatgaccaactgggggccgccgtggccagaacgtcgctttgcgcaatataccttctttcttcaaccggagaggtgatgagctggaaccttggatgccgtgaaattaagggctgggaaagccgtgatatcagagggcaacatatttcggttttttacgatgaagatgaacaggccaggaacatacctgaggccgatctggggtatgcacgtgagcatggcaagtttacaggcgagggctggcgcctccggaaaaacggcagcacattccgtgcatcagtcgaaatagaatttctcaacccatctgaggaagaacacgctgcttttattaaaatcgtgcgggacgtttcgcatgattatcaggaaagggcggcgctacgcatcgctcaacaggttatccagaaaagggaaacagagttatcagacaccaataaggtgctcgacgctgtgttctgccacacgccctgcgccctcattctgtgtgacgtaaaatcgggtggcataatacgcgcgaacccgacagccatgaattcgccccatctgcaggcgctggtattgagcggtaataccctgacaggtatccctgaggcgttgccagccgatctgagtgctgtgttcaggcaagcctatgatctccttcccgatgaagggttcagtgaaactgtctcttcagacgataccgcaccggaattttcactgcggatttctgcagaaaggctgaattcgggcggcggagaggactatcttctctataccatactggatgtcaccgcagagtatcaggcagcggcaagagctaatcacctggcactgcatgatccactgacagggctgcttaaccgccgtggcctgatgcccaggctggagacgcttctgagtggcgacagcccctttgccgtcatggtctctgacattgaccgctttaaaagcatcaatgacgttctgggccatcccacaggggatgcactgcttattgatgtttcagcgcggctacagtccgtcctgcgccctgaagatatactggcccgcacaggcggcgacgagttcgttgccgtcttaccgggcataagctcagcagcagaagcaagcgaaacggtatcacgtctcaccgcagtgctgaaggaacccttcatgctgaaaggccgcaaggtcacgtcgggttgcagcttcggagtatgcctttttccgggctacgcgcgggatgctgaaagcatgttatcggcagcagatatcgccctgtatgcggccaagtcagccggacgtaatggctgggtcatctttacagatgagcttgccagttcagcgaaagagcgcttcagtctggaaaacgacctgcgtggtgcgctggagaacggtgagcttcagcttttttaccagcccgttgtgtgcagcgtaagtgaagaagtcgtgtcatatgaagccctgctgcgctggcatcatcctgtaaggggaagcgttccgcctgacgttttcataccgcttgctgaaaaaaccgggcttatccatgatatcggcgcatttgcgcttacgcgtgcctgtactgacatggcaggctggtcgggacaggcgcgggtggcagtaaacatttcgccccgacagttcagagacccgcaactggcgaacagagtgaaaaacgtcctgattcatagtgggctgcatccaaacaggctggaactcgaaattaccgagtccgcgctgttcgacaaccccgagttcagttatgaagtaatacggaaattcagggagacaggcattgatatggtgctggatgattttggcaccggtttttcttccctgagccacctcagctccggacttttcagcaggataaaaattgataagtcatttatcagcgacctgcaccgggatgccggagcggcagctatcgtcagctccgttctttcactttgtcgtcaactaaaggttgaagttaccgcagagggcgtggagacacctgcacaggctgagtggctcagaaaatatgaatgtcctctgctacagggatatctctttggcaggccggggccttactggattcagaagtgaagtctttgcccttatcaggacctgccggcggcgcttacattttgcgccgcgggtcaggttttaactggaaagaaagtgcatgcctgagggatcgataacaaaaaacgcatgccttcttttcagggatgtcattagggcaaagctcccgtcagttactgtcctgataactgacggccatattgacaggcgtgccgggcggtgcgttacacaacctttatagggaatgttctgcacccacatcgcccggccattcggtaaatgccgacggcgtagtttgagctaatttaaggtctgtgctgtacgccgttccctctttatcgtcgatgtatgaaagtttacttagcgaaatacgccgtaaacctgcctgaaagactgaaatctaaagttgtttcacagtttcagcgtagcgtttatcgctgaacttgttttcccatttggctatgacaataggggccagcgtatttcccagaacgttaagcgccgtattaggcatatccattaagcggtaaacgccggcaatgaaagcaatgccttctaacgggatacctgcgctagagagcgtggcggaaagaatgacgaacataaaaccaggaacaccggctgcgcccttagaggtaatgaccatcgtcacaacaagcatcatctgatcggcaagggtcaggtgaatgccatagatttgcgcgataaacagcgttccgatgccaaggaaaagagaggcaccgtcaaggttaaatgaataccccgtaggaataacaaaccctgaaaccgttttatcgacgccgcacttttgtgttttctggatcagctgtggcagaacagatgttgagctggcgcttgaaaaagcaagtatcaattcatctttgataatgcggataatggtaaaaatattaatgccgacggatcgggcgatgagtccaaaaacaataataacaaacagaatggcggtaatataagttgtggcaatcagtttcaccagcggcagaagagacgcgacgccgaaatcggtcaccgttaccgctatcatgccaaatatcccgataggggaataggccatgatcatgcctgtaactttgaacatcccatcagcaatggcagaaaagaaattgaccatgttcgcctttttttcattttcaagcgaagcaataccaatgccaaacatgacggcaaagaagatcacgggcaacagattgccttttgccatagcatcaacaatattctcagggataatgctcaggatcacctgaccaagcccatgattcgctgacgcgggcgtagcgacactgacctgatgctgcaccatcgaagacaggtcggcccctgcgccgggcttcaccacgtttcctacaatcaagcccacgataatggcggtggttgtcacgcaaaggaaataaaaaatggtcttcagccccattcttcccaccgctttactgtcagaatgacctgcgatacccactaccaggcacgaaaaaacaaccggaataacgatcattttcattaatttaatgaaaatattgccggcaggcttaaatatctgttctataagccacgcactgtgcgcgggatatagattaagtaggtaacctattacaatgcctgccacaaggccgacaacaatctgccatacaagggggattcctggctttttcatttagttcgtacctggtgttggttaataattaagaatctgctagcgaagcaatgcaatggccgttttgagtcgccggcatccttcttcaatgacgtcaactgaacttgcgaaagaaatgcgtaagtaaggagaaagcccgtatgctttgcctgtaacggttgcgacgcctgcgtcacgtagaaaatactccacgacgtcatcgtcagaggttatacggcttccattgggttttattttaccgatcagcccggacacattaatgaaaaggtaaaatgcacctgctggtgggttaaaactaaggcctggcaaagtgctgagcagttcgacaatgcgctttctgcgcgcggtatagatggtgagcatctcctttacgggctgctgatcacctgcgaacgccgcgactgcagccgcctggcttaccgaactcgggcaggtggttgtctgggatatcagtttggtgatagcgctggtcagccactctggacccgcgccaaatccaagacgccatccggtcattgcatatccctttgaggcgccgttaataataagtatccgctctttcagatccggcgcgacagcggccagtgaaaggtgtgtagcgtcttcgtatacaaagtgctcatatatctcatcaagcataatgagcacgtcaggatattttcgcagcacgtcggccagcgccatgagttcttcagcacggtataccgcaccggtgggattgttcggataattaagcaccacccagcgggtgtttgccattatgctctcttccagttgctcagccgtgagcttaaagtcattggattcatcaccctctacgataaccggtgtgccttcattcagaatggcaaggtccggataagatacccagtaaggagcatgaataatgacgtcgtcatttttatccagcgtggaagcgaaagcgtgaaaaatgatgtgctttccgccgctaccgcagacaatttcgtttaactcatagcgaagcccgttatcacgctcaagtttttcacagattgccttacgcagaaccaccgttcctgctgcgggagtgtaatgcgtttccgagtttttaagggcgtcaacggtcgctttgataatatgttcgggcgtatcaaaatcaggctctccgatggtgaaattgataatattaaaaccttcggatcgcaactgagtgacaagctcgttcgcggcaatgctgggtgatggcttgatgctttttaatcgttgagatacacgctgattcagtttcatcacaggtatcctttttcacgaagcaggtctgtgtaccaggtttggtcttcctggcctgaagcaatcatttcctttacagcctcttccttctgcgcatgttttgccgccagcctaagaagttcatccttaaattcgtacgcaaaattcacgatgccatcttcgtctccgatgatgatgtccccggggcagataacctgaccgccgatgctcacaggcacgtttatttcaccgggaccggttttgaaaggtcctttgtgaatgatgctttttgcatagagaggggtatgttcaaacgaggcaacatcacggatggcgccattgacaacaaatcctgcgcatcccctgcggagacactcaagtttaatcagctcgccgatgatggcgttattcgtatcgccttgtgcgtcaatgaccagcacatggccttcttcaatcatggtcatcgccctgtaaaccataaggttgtctccgccgcgcacctttacagtcaatgcggtaccgataagttttccggttttattgaagcgctgcagaccgctaataccgatatttcgcgacatgttgtcgctgagatgtggggtcacaacgtctctgaaagattcacgttcagcgcgtgtcagtggtctggcgggcggattgatatggcttcctgggatggacataaatggcctcagtgatttttaacattaaattaacaaactggttatgtttgatactatcggccatgaaagattgtttttagcgatattttgatatagttaatcagtcctttttttcatgaaagaaagatacttcggctataaagttgataaatatcaaaaacatatggcgttaagcggtgaatgtaaaagcagtaagctcgcctcttttatgggaataaaggcgcttttcggcgaagacatatgaatttcctatgtcagttctgtgatctgagcaggaatttttcgcccctgctattaaaggtctctttcacacatggtggggcacaccagagactgggtgcggctttcgcagcattctggactttttgtcggccgttttaagaggtaacccaggtgataacattcaaacaaatggatgcgctgatatggatagttaatctcggcagttttgaagcggccgcggagaagctcaatatgacgcagtctgctatatcaaagcgcatacatgaacttgaagtctcttttgatattgaggtatttgaccggtcgagcagaaatgcgcggctgactgagaagggaagagagcttcttttttacagtcaggagctggtagagaaaagaaaccacctgcttgagaggatcagcgacaggaaggttctgatttcacaactccggctgggcgtaactgagctgacatcccttacctggctacccgagctgattcagcaaatccgggaagtctatcccagggtacagatagtgcctaccgtggatgcctctcccgttctgtatgattccgtccagaatgacaagctcgatctgattattgcacctgacatgtacgacgacgttcgcctcaacgcgtgccttctgagcagtgtcgaaaattcctggatgtcgtcgacagcactgatacccgctgaagagaaaattgatattgacgaagcagcaaaatattccttttttgtgcagggtcccacgtccggcacaggtctgatatatgaacgctatttttcaatgcgcggcattaaatttgaccggaatattgtctgtaacaacctctttgcccagattgggctgacggttgccggtatgggtattacctatcttccccgaaaacctttaatgcctttgctggaaaaagggatactcagggagcttgatttcaaacccaggctgcctcttgtcagatacagcgcaatttatcgggccgatcgtgaacaaggcatcattcctcatattgctgatattgccaggaattgctgcagtttcgataagttccttttcggtttctgagtaacgtgctgaaatcaggtaacgcgttaagcgataaaaatcagtttatcgcccgcagaaacctgcactttccgacgtccagaacggcataacactactgcactgtgcacagccacgcagcggcctagaaaccataaggtgtagtgttggttatacggaccgtaagcgtgccggaaaaagagtattcgcgtcagaagcacactgagcgcgcatgcggggagacggcagggatgtgatgtttaccagaatgaacatattcagtcgccatgagtaaatgtgtgctgttcactcatactggaccttgtgcctaaaccagtcgatttggtgctcaaaaatggactattaaccagaggataaccttttgtctgcttgctatcaggttgttgaaactgttccgtcagtagaggatttttgccgtttacgcatcatcgcagggctgacgccacgtcccgcagagggcgtgcgcctggcgcttcccaacagttgttatgcagtccatatctgcttacagaatactgtcgtcggcatgggacgtatagtgggtgacggcgccctcaatatggagattgttgatgtagctgtagatccacagcatcagggcagggggctgggccgccaaataatggaaagtttggcaaactggctcgataacaatgcctgtgatggcgcctatgttacgttaatggctgatgtgccagagttgtatgaaaaatttggtttcatacgagtcagccctgcaagtgaaggtatggcaaggatctggaaacgaaataaagctacataaaacaatgcctgcttcttgctcatggtggaatttgtccggtttgtgccaggagtggacgtcaacgtcgttcaaagcatcacttctgagactgaacataacaatattcagctacacttgttcctgttttggcccagagcaggaaaatcccatcatatcagagatatatttttaattagtagtatttaaatcaataacatacatggccctttaatgatgcaagtgatacttgttcgacacgcggaaaccgagtggaatgtgagaggtattattcagggacagagtgatagcgcattgactcttcggggggagcgccaaacatcagccttattggcagcgtttgcagcgagtgattaccgggtagaatgtgtctacgcttctccgcttggccgtgcctggcaaatgggacagagcctggctgaaagcttttgttgctcactgatagctgaaccggctctaaaagaacaggcatttggtcagtttgaaggcatgacaaccgtacagctctcgcaacaaaatccggacgctgcaaaggcgttattcaaacttgatgcagagtattgtccgccagggggggagtctctctcacaagcttcgcagcgaattatgcattttttatccaatctcgataaacaaagagatcatgaaacaatatgtattgtgtctcacgggcaggtcattcagggtgtgcttgcgattctaaaaagtggaactgtggatgattttcacaggtatgcacaacccaacgcgagttactccgttttcgatctgattaatggaagatgtgccgcgctcagatgggggattgctacacatttacgtctcctggattagccgttacctttcagtcattcaaagctatcatgatttaagcacaactttatattcttcaacgatactgtatataatcgcagaaatattaaattcaagagatgatcaagccgctacggttgtgaaatttgcaaggattttggtaacaaagctgtttttaatgctggatgaaaacgagtgaagataatttaagcgaaacttaaccatttaatattccaaacgcgctgtctatcaaattgttgaatgggctaactatgacgatacaaagaagctaacttcagtaaagttggactctcttttacaaaaaatgtgcaactgaaatacataaacgctcaccaaatatcccagtggaatacaagctgcgaggaacttgttagacgcaaacccattagcacccttatttattgtcatctaattaatggtgaaattattttaaattaataaggttatttaagagttgaaattatactgattccgtttgggttttgtttaagttgaattgttaagttattgattaatttgtaaaaataatctacacgcaaattgttgacattaaattatggttatgtaaatttatgtaagccgacccgtagtggttagctaacctaatgcttaagcaatgtattattttgatcggcacaagtatttctgtccatttcaacagataggagtaataagatgcaatcaaccgcagaaaagctttatcagcctgttttcgcgagaaaacctgagcctatcaagctctataaatcagaacctaaagacatctgctttagcgcaataagcactatggtgcagggtcgaatcaaacgtgacgccaacctactgatgagcatttcggatttcatcgctcatatttaattttaactaattttaggcctgctgtaatacagcaggcctatgatgaggaaattactatgaatagtgtgaaaatcattctaaaagacaggcttgataaggttcacattcttaaagcgcatgatgaagaaccgttacgtgtttttttgaagagaaattatatacctagagattcagtcatttgttatgtcaatgaaaaaataattgatgaccatacctacaagattaataacaatgacaaaatcgtcttagatatggttcgggcttatcagctacctgaatactgcagaacgttgaggctgtgggaagatgaaggggtcgaatctactaaaacagatgctgaatcagtttacacaaaaaatgttttgtggttcaacgataacggcatttgtgagatgaaggagactcagttcgaccctgatagctttgtcaaatatgtagatgatatgtttgtccagggtatcatggaaaaaaaactcataatcgagaatcaaaaaattgttttagcgttgtctggcggcagagacagcctggctttgctttatttgcttagaaggaacaaagataagctccctcctcatgaactcgttggcgtgacagtggcagatacagccgcttctacaaaggacattaaagtggctatggaagccattcaaaatcttggagtaaaagattacacggttctacccttagagtatgtaaatgaaacaatgaattttaaaaatggatttgaaaatgcaattgaaaaaattcttgtaacagaaggtcgtggccactcaatcacgctgtggcatcacgttatgcgtgcatgtgtggaacgctttgcccgtgaaagagaaatctccacaatttcatttggatatcatttcgaggatttgtttgccagcgtgtttaggacatacacactcgggactttattaggtgaatccgcacctttgaaaacatggggagaattcattcatacatctcctctgtggacaattacaaagaaagagttgacgctttatctaaaattcgttgcacctgagacacattcaaaaaaaggttctccgacagattatgacaggggagatcataatagggatataaactatttcatgattgatttgctttcaggtctctggcccggattagggtttaacttctttgagtcattggaacgactcaacaaaaattacaatattcaaaaagcagaatatgaaatctgttccaattgtggaataacctatactcatgcttatgggaaagatattgaccaaaggaaatttattcatgtatgtaatcattgctcacacttaatgagcctgggagagataccatttttgaataaagtaaaataaatgcagaggtggaaaatggaaaataaaaacaagctgcttttgacagatgtcatttcctcatttggcacgggcattagtgatgtggcaattattacaatggcctacatgattaccaaatcacccgaaaaaacggcctacattatatctttgagactaatctcaagtatgcttgttttttttctcattcctcatttactgaaaattttatcaatgagagaactaagcattttcactgacttcgccagatctgtaacttgtttaactatagctttcacttggaatatctatgtacttgcaattttatcaactctgatatctctttgcgcaggattaaacacgacactgaaaaacgtggcatttcagaaatttgttgatagtgaagaaagaataagttttgtttcaaaacagcagttttattataattctttcggtttaatagcacctattatatcctcactgacaataggaatctttgggataaaatttattttttatgtcgaaagctttcttttcctgatgtctacatgtatagttttctcacttgaagaatggacacctgacaatctatctcaaaagaaaagtattttttcaggttttacttatattttcaatgataaagttcaaaaaaacattcttttttttagattatccataattacatctatggttgcttatgaaattatatcgacttacattcttactgataactacaaagagctcattaatcacataaatattatctatgtatcttcatactctactgttgttgctttgttttcaagtatgagtactttttctttgttagtaggaagcttgatggcagggaaaatattcaaaattgaaagtattaataaatcctttatttcaggggccgtgctaatatctgtaggctgtctgatatggtccgttccattgactaaatttctggttttgagttatttatcaggaacattcatcatatatttagggttgtcgctacttaaaatttcattatatagctcagggcaggagcttactgacaaaagtaagttttcagaaataatagccacttccgatatgatatcaagaagctatcagtctttgttaggttttgtgattgttgttggtatagaccacttcactgcagaaaagtgttttctttttctcgctttcgctgcgcttggatcactcttctttagctcatcaatatacaagcctttgattttgagaaaagtaaaagatggttaaatgttctccttagactatactcatgggtttattcaattcttatggagtcgtgaagtctttatcaatatccatgaggacttttagctgtcgaggatagtgaatgttcagcatttcagaagtggataaaagtgattctgacctggcgtggctggtcagcgagctcgatgcctttcagcgcgaactgtatcctgcagaaagtaatcactgtctggatctttcaaccgttaatgacgagcagctccgctgcgttatcgtacgtgatgaaggcggcgcacctgcgggttgtggtgctttgctgtttcaggaaaatggctcagctgagattaaacgggtttatattcgatcggaataccggggcaggaagctcggagagcggataatcagcgcaatcgagacgatggcttcagagaagactccgtgcttattacggcttgaaacggggattaatcagcaaccggccatcgcactttatcgtaagtgcgggtacgaaatatgcgatgcattccccccgtatgcagcagatccgttgagtgtgtttatgtgcaaagacctttcttaacttcacgttttttatgctactcaggaaagttatgctcaaggcgttggatacatatcataagtgagacgtccgctcctcgctcaccgcgactttaaatgccgataagtccatcttctgactgatgtaagcccgtcatactgatgccgaagcctcggttgatcaacaggctgagattatgtacacaggcattttgactcacctttagcagaacgttgcccgccacccggtctttgtcaggcccgacgctcacaccactggcgatgccgtgccttgtgagcgcatctctgttacaggccaggttcaggatccacccatcccgcatgacgacatttcaaaaaaatcacgccgctcaacgcttacgggagtcgctatttttatctgtcacgaaacgcattatgcagaagtcgccacatatgatgggcggctggggtaaagcgcctgtctgagttccgtaacaggtgacactgggcgctactggcgatcgggtggtcgagcgggacggcgacaagtgtcccctgacgaatggggtcggcggcggcataggcagtcataaatgagacaccgagccccgcctggctgaggttcatggcggtggagaacaggttgcatcggtaggccgggtgaaattgcaggccctggcttttgaacatggcgttcatgtggcgctgcaagccaaagttctccgtcagagcgataagcggatgagcgttcaactcttcaatagtgatgctggcgtgaccggcgataggatgctgtggcgcgaccacggcgcaaatcggcccccactggaaactgtggcgcttcagttccggtgtgccaatcgggccaaaggcgagcgccatatcggcttcgccgctgacgatatcgttcatcatctcctgcatgctgccgaccacaatatcgacaaacaccatcgggtaagactgggcaaactcgcgcatgactccttcgataaacgcggtgatcagtccgccgccaatgcgcaccgaaagcgttccgccgcgcatatggcgcagatctttaagctggctctccagcttttcgcgccgctggcggctggcaaaatagtcctccgccagcagccgtcccgcttcggtcaataccacattacgcccgcgccgttccagcaagggaagctgtagcgcacgttcaagttgggcgatctggcggctgaccaccgacgcgttaacgccaaggatatctgccgcgcggcgaatgccgccttggttacccacttcatacaggtaacccacctgtttatcctggaacatctgccgcattccctcattactgttgacctgagagcaacaataacatcacttgatggctatttatcaagccgtttaaatagtgataatcaaattaaccgccaaatttggtacgtcagtaaaaaagaaaaaggaaatcagtctcactgcaccaaaagtgcgcccagaaaaggggagaacgtatttcattgcgcttttatacgtgcacgatgaaataattttcccgctaatgcgcttgaatttctcgttatttttcgggaaggggttttattgcaaaaatcagcctggcgaaaggcgtttattttacggctgggctattcaggcatggatcctgcttagtatcaggacttttccattatacatgtaaagagagatgatatgagcgaatcaaaaacactgaagcagccagaaaaagaggcagcagaggagtggaaagtggggcctggcgcgtggatttcactggtcattgtgctgctggtcttctccggtttcttttttaaagtggatggcatggcctggttgggcgcgttcgatttcaccacgcttggcggcgcgttcggcacgatgaagacgccggaaaccaacacctttatcggcagcggcggcctgagcgccaaagccggttttctttttgcgctctcgctggtgccaacggtgatgctggcgctcggcctgctggaaatattcacccattacggtgcgatccgtgcggcgcataaattactcacgccgctgttaaaaccgctgctcggcattccaggttacaccggtctggcattaattaccgatctgcaaagtaccgatgccggtgcggcattaacgaaagaactctatgacagcgaaaagatcacccgcaaagatgtggtgattatggggtcatggcagtattccggtgccgggttgattaataactatttttccatcggatcggcaatgttcgcttccttaaccatcccgatcattattccgctggttttaatgttcgtccttaaattcgttggcgcagccgtggttcgcctggcattaaatactgtttataagcgagatttcgacaatgagtaatcaagcaaaagtctccagtaatccgtttgatattttcgttattggcgcgcgcaagggttttcatatcgccattaataatttgatgccgaatgtattaatggcctatgtgatcgccgaaatgctcaatttactgggcgtgatgcagattattgggcacgtttgcgcaccgctgatggggcttttcggcctgccgggcgaagcgatcaccgtgctgttaaccgcctggctctcttcctctgccggaaccggtgtggccgtcagcctgctgagcaaaggccaacttgatgtggggcagatcaccattctcgcgcccgctatctttttgatggggtcgcaactccagtacatgggacgcctgctgggcgtggccgatgtgccgaagaagtactggccgttattgatggcggtcagcattctcaatgccgtaatcgccatgctgattatgcgcgttattgcctgagcactaaggagtaagacgtgtcacgtacacttgagcactttaattacctgcaccaaatcccggaactggggttcgaagagtacaaaacatccgcctatatcgcggacgtgctggcggcggcgggctaccaggttacgcgcaaggtgaataacaccaccggtattgttgccgtactggacagcggtaagcctggtccgacgctggcgctgcgcgccgatatggatgcgctgggacatatcattgatggtcagcatgtggcgcgccacacctgcgggcacgacggccattccacggtcgtattgactaccgcccaggaggtgatggcggagggactggtgaaaaacggcaagctgaagtttatcttccagccagccgaagagttgggcaccggggcaattgcccttaccgaaggcggcgtgttggatgatgtcgatatgttgctcggcttccacctgcgtccgctggaggagtgcccgatggggcaggccgtgccagcgatgtactactcggcgtccgccaccgttgaagtgatgttccatggcaaagcggcccatgctgcgcgcccgcacttaggcgtcaatgcgctggatgccgctgcccatgcggtgcaggcggtgaacggcattcatcttgcaccgtcgctgacatggagcgcaaaagcgacgcgttttctctgcgatgcgggcgtcaccaattcgattccggataaagcgcaggtgtgctgggatctgcgtgccgcagaaaacgaagcgatggatgtcctcaagccgcaggtgctgcgcgcaattgagagcagcgccgccgcgtatggcgcgcgtgcggacatccgcgttctgaaagagatgcccgccgccattatccatgacgaggcaaccgaggtgatcgcacgaggtattcgccgtgtgtttggcgaaaccggcctcacagcgccgaaatcaacgccgggcagtgaagattttttccactatttgcgccttcgtccgcagatcaaaggcggcttctgggggctgggcgctaacctgacgcccggcctgcatcatccggagatgcattttgaccgcgacgcgctcgcgctcggggtgaaagtgtttaaagcctgcgtgcaggatgtgcttggctgataatcggggttttcagcgtgacagccgcctcgcgctcgtcggacatcggtgtcggagaagagacagacctgacgatgttgtcccacggcgtgcggccctgacaaaagccgtggttgtggccctttttggtcgggaaggccgctgactgtggcgagatcgccaatgcgcctttctgacaggctctggcggtgtgcggagaagaggtgaccagccaccgcgccgaacaggggcggcgcggtggctccgactatccctggcgttaacgctatctgtcgccgccatcagtttcactccatcaggcttctactaaccttgatgttcagcctgctgatggcgcaaatacagcggcaacattgattcatcgacgttgctaaaaacgctcattcgccagtgccacactttgcctgccgtcagacctcgcattatctcgcgctgctgccagccggggcgcagcctgtcattcaatgcagtactgttgcaccgcatggtgccgatccagcgtaaaaacctgcaaggtcgttttctcgttatccacaataaacacggccgtcgcaagcgtgttctcttcatccggatcatcgggtgacagacgataaatgggcagggcagcgtcatgttgatccgagaggatggcttttgccgccgcgccatcaaggtgtgcctgtgtctccagccattcgtttaaacgctgctggcgtgagccggagctctcagtaatcacctgttcagtggtagcgagttttgcatgaatcaggtgattggcatgggcgaagacatcgcgcaatggtgtgacagaacagccggaaccggtcgcttccacgctaaacaggcggctgtcgccccgttgccctaaggtatggtgaaacgcacccgcacgcggtgccgccgtcaggatagtgattgcctcatccaggcttgccgcattcagcgccgcacgcgccagtatctgccggggaaggcccttcgggcgatgcaccgcgcgaatgttattgaccgtgttgacaatccctttctcattcacggcaaaggtgtgaccgcaaatcgaacccggataggcaaagctggtgaatctcaggccctgttccgggatgacggtgaccatcgcacagtcatcccgtagctgcggaaaaccgtcttcgttgtgggcaataatccgttcacccttcgcattggttcccgccacggtggtgcagccatcggaggtcgagcgcaccaaatcgccccggcagttccatgcaaagacctcatcaaccggtgcctgtaaaccctctgcaaggccttccagctcctgccagataagtgggtactgctgctgaaccagctggcgcatagcctgtgtctgttcagcgtctttcatcgccgtgacggtttgccatagcgccgttaaggtgagtttgctgtgccaggcttcacggccaaattcaccgagctgctgaccgattgcaaaagcggaaccatggactgtgagtgctttcatcgcgtttttattcacttctgttcaggagacatgctgcaaaaattctttgagacgcgggttgctactggcgttgagcagcatatcaggtgagccatcttcggcaatggtgccaccatcaataaagatcaaacgtgaggccacatcacgggcaaagccaatctcatgcgtgacaatgaccatggtcatcccttcttcggccagagagcgcatgactttcaacacttcatggcgcagttcagggtccagtgctgaggtgggttcgtcaaacagcatcattttcggcttcacggccagcgcccgggcaatcgccacgcgctgctgctgaccacctgagagttcagaaggatagtgatcggcgcgttcgcgcaacccgacacgatccagcaacgccatcgcctgttcacgtgctgcggctttgctctgcttacgcacgcgaatcggtccgaacatcacattttccagcgccgtcagatgcgggaacagatgaaactgctgaaacaccatcccggcttcgcggcgaatttcgcacgcatcggcatggggatcggtaatgtgttttccggcgaccagcaacgtcccggtggagatctcctcaagcttattaatacagcgcagaagcgtggattttccggaacctgaggggccaataatgaccaccacttcaccggtttcaatctttaaattgatatcgtgcagaacctgtgtcgtgccaaagtttttggataccgcgttaaattcaacgatgctcatagaatatgcatccttttctccagttgcttaagcagaaaactcaggcacaacgtgacggccagataaatcatcgccacggcggtccacacttcaagcgcacggaaattaccggcaataatctcctggccctgacgcgttaactcggccacgccaatcacaataaacagcgacgtgtctttaatgctgatgatccattgattacctagcgcagggatcatacggcgcagcgccaaaggcatgatgacatgccacagcgtactccgttgcgataagcccatggccagacttgcttccttgaagcctttattaatagagagaatggcaccgcgggtgatttcagcaatataagcgcccgagttgatcacaatcgtcacgatggctgccgtgaccggatcaatacgaataggcaacaccatgggcagcgcgaaataaataaacatcacctgcaccatgatcggggtaccgcgaataacttcgacaaaaatcagcgaaagtgtttttgctattcggccacccaaggcacggcaggtgcccgccagcaatccaataataaaaccacccaataaccctgacagtgaaataatcagcgtcagctgtaatccctgcaaaagaatcggcaacgattcccaaatatatttactttcaaagttcataattcaacccatggaacgaaacgaggccggcgtacaccggcctggcgggattatttcggttgtttagcaaaccatttcacatagattttgttgtaggtaccgtcagcacgcagtgccttaagggccgcattgattttgggtgtcaggctgctgtttttctgcatggcaaagccgtactgctggggcagaatgctgtcattctcgccaacggctttaatcttgccatcgcctgcagttttaacgtagtagaggacattcggggagtcgtgcacgacagcatccaggttaccggcctgtaaatcgaggtaggcattatcgatgttggggaattcaacatagtctgccttatatttgcctttcataaagctggcggcggcagtgccttgcttcagtccgacttttttgcccaccaaatcgctgaatttggtgattgacgtgttgctgctttttactgcaatcaataaatcagcattgtagtagccatcactaaaatccacgacctgcttacggggttcagtaatggtaatgcccgccatggcaacatccagattgcgggattgcaggccgggaattaatccgccaaagtccatcggacgtaattcatagctgacattcattttttttgcgatggcattccataaatcaatatcgaagccaacgtatttatcgccttgtttaaattcaaaaggcacaaatgccgtatcaaccccgaccactaatttatcctgcgccgtcacagcaaaggtggcggaacaggccatcagcgcgaatgcaacttttaacttattgaataatccagacataataaccctcagcgtcagtgtaatagcgtgcagtgaatgacacccgatggcgtgcatcgggatataaaaaaggaaaaatttaattattcagggcaggtcaggacgtgccctgatttaatccaaagcttacgccggaataatgtgatcccgtgaatcgggcaccggcgtctgcgcgccgttcatgaccatggaaagaaaactgtaataaccgttaatgccaatcagatcgaccacccctttttcgccccataaaccgatggcctgctgccaggtggtctcactgacgttttgctgctgatgtaactgctggcagaaatcgtaaatgacccactcgtccggctgtaaatccgtgggctgacgtttttcattgatggcctgcacggctgccgctgaaatccctttttcacgggctatcggcgcatgaatcgcccattccacgggctgcgaccagtgccgtgccgtcatcaaaatcgccagctcagataagcgctgccccagcgcactgcggtagcggagatattcacccatgcgttgtgcgtgcgccatcagctccgggctgcgtaacagcggctcaaaagggggaagcagtgcgccgcgcggaccgttaatgatctcttcagccagtacgcgttgctcatcgtcccactcatctgctttcagcgggggtaaacggttcatcataatctggctgtctcttcacgaatgacggtattcagcgtatccaccacaaaatcaagctggctggtcgtcacgataaacggcggggcgagtagaatatggtcgccatactggccgtccaccgtgccgcccatgggatagaccattaatccgcgtgccatacagtttgctttgatggccgcatggagtttcaggcccggatcaaaaggtgttttacctgctttatcggagaccagctcaacaccggcaaacagaccgcggccgcgtgtatcgccgacatgcggtaactcgcccagcacctcacgcagtgcgttgtgcagataagcaccttgctgtttcaccgcgtccagcaaattatcccgctcaatcacctgctgaaccgccagcgctgccgacgcggcggtggcgtgacagatatacgtatgaccgtgctggaacagcccgctactggccttgatcgctgacacaattttctcactcgccagcacggcgccaatgggttgataaccgccgcccagtcctttggcgatggtgactaaatcgggcaccacgtcatcctgttcaaaggcatacagcgtgccggtacgccccatgccacacatcacttcatcagcgatatagagaatgccgtatttgtcgcacaggcggcgcacgcctttcagatagccaggcgttggcggcgtcgcgccggttgttgcgccgaccaccgtttccgcacaaaagccaattatggtttccggccctgcttccatgatggcctgctccagttcggtgagcaggcgatcggtatagtgttgttgggtttcatccgcaagccgatcgcgatactcattacaggcggagacacggataacgtcgataagcagcggcgcaaactgacggcggcgccattcattaccgcccacggccagcgcccccagcgtgttgccatgatagctttgcttgcgggctataaatttcgtgcgtgaagcctgaccgatttcaacaacgtactgacgggccagcttgagggctgtctccacggcttctgaaccgccagagacaaaataggcataattaagatcgcccggcgcgtttcgcgtcaggtgatcggcaaggtgttccaccgtgtcgctggtaaaaaaactggtatgcgcgtaagccaactgatcgatctggcgatgcatcgcggccaggacatcgggatgtgcgtgtcctaaacaggaaacggcagcaccgccgcaggcgtccagatactgtttaccgcttgtatcatagaggtacgcgccttgtgcgcgcgctgccacggcgggcgtgctacgcaaactacggtggatgatgtggctcatgctggaccctgctcctgaatacgctgtatacactctgcgcatcttgcaggattcatttgaatcaggtcaatgaaattatgattcaaatgtattctgttttcttatgaccgatccctttgtctctttctgtcaggttttaccctgtaccacataggcacccgattcaattaaatagcgttcagcattttcaattttattcaccgcatcacggccgtggcgcgcgaccagcatggcaagtaagcactctgccagccccatgccagaaacaacggaagggaaaaatgacgggctgtcgatggaaaacaacattttacagtcggcggcctgggccaggggcgaaaccagagaatcggtaatcgccacgatcttcgcgcccgcctgttgtgcggcacgcaataccgccagcgattcacgcgagtagggggcaaagctgatgagcaacacacaatcccgagaggtgaattcccgggtaaagacttcgatattactcgccagaccatcaatcaatgttaccttgcgatgaaacagccggtagacgtagaacagcgaccaggcaatggggaaactggcgcggaaaccgcagacgtagacattctcagccgcatccagtagggacacggactgctccatcatcggacggttttggttatatgtgaattccagattggcctggtgagcctgaaacatctcgctgtagagctgagactgcggacccgacgcgacgagcttttccgctttggatacatatgtatcattgcgtagcccaatatcatcgatgaaagcatctttaagttcaccccagccgctgtaacccagtcgctttgccagacgtagcagggtggcaggtttgaccccggcctgcagggcaaaggtgcgcatcgattgcacaaccagttgattggtattctgcagtgagtattccgcagcacgctgcagttcagcagacaacgcattgaactcgctgagaatggtttcccttggattcatagtcacgtttcacaggctttaaggttctggtatctaaacacatttgttaacgagactctatacacgggaaaatcccccgtaatgccttcgcctgataactgacggcgggctaagctcagcgcagtacaggttttattagcgttcttacggcgtatttgatcccgccagggcgttcaggggcgggctgttaccgttctgcccttgctacgtctttaagccggtcatcacggggtcagggaaaacagattattaacgctgccatcatcgtcgacaggctgtctggatgaaacggctctcgcgtttttgtatcgcctgtaatgcggctgcttgctaaacatgacgcgttatttgaaaagggcgaaatggggcgaataatcggctaatcaccatattcgcattggtatgattgaaagtcgtaaacaccctgactgcatctgggcggtaattgagcagttaaacacaatgctcaaaggaaaatgaatatctgcaccttttaaggatcgcaatgacaaaaggtttgatggctttcataaccctcagaaacaggctcctcaatcgacagcatgggtgccaaagaaatcgatattctcatgattcttttcctgaaaatgacggattgatatccataaccctctccgtggctttaatgattttcagaaattaacgcgttaataaacctgaaaatagtatcaggtgtaatacggacagcggcggccatatccgccctggccgctgttctcatttaaccctgaacgtgttcgccatcacctgtagcgcatgagcgtgcagcctgtgagcagcgatggcggagggtgaaagccacgcacgttattttgcatgatgtcatctatcggatctttgacgaggcagacccacgaaatgccgctatctgttcagaggatggcagtattaccgcgttttttcgccacggttttgacagcggctcgacccagatatatgtcacaacttttgcactggtgacggaatgtttcaaatagcgtcgcgttgtattttctggatcattgcagtgcgcattgcaccctgatctcatgcttaatatcgctataaatgtcgacggatatttttatttctgtttaaacgccttcctgaaacccttatctgtcaggttctgtgatccagaatgtttcttacataaacagttacgacagtaaaatattgctggcacacaatatgctttattcccacgtacaacatctaataatcagataagggcatatcatggcatctacaggtctcaaaaagaaattagggttggtcgatctgtcattacttggcatcggctcaatgatcggttcgggctggttatatgccgcgcttaacagctctggttatgcgggcagccataccggctgggcatgggtgctgggtgccgtgatcgtgctgatgattggtctggtttacgccgagctgtcctcggcactgccgcgcgcaggcggttttgttcgctatcccaattattcccacggcaacatcgtcggcttcgtgattggtgtcagttctctgctggcttataccagcactgccggggtcgaagtggaggccgtgcgtcagtatgcaatctattggtggcccgcgctggggcacacggacggcagccctacggggttagggtttgttgtacagattgggctgctggtggtgtttttcctgcttaactactggagcgtcagcttctttggtcgcgtgaacaccattgtcaccaccttcaaatttatcgtgccgttactgactatcatcacgctcctgctttactttcatgcgccgaaccttgatgtgccaccgtcaccacctggcggtgcacatggcgttttcagctcgctgacgggggctgggattgtttttgcctacctcggctttcgtcaggctgtggattttgccagtgaagccaaagatccacagcgcaacgtgcctctggcgattggtattgccattgctgtcagcttcgtgatttacctggccctgcaatatgcctttatgggggcagtaccggccgatttgctgtcacaacatggctgggcagggctgaaggaggtattccagtctccctatgccgacctggcgcgcagcctggggctgacctggctgattaacctgattctgatcgatgcggtgatttcgcctgccgggaccggcaacatctatctggcaggagccgcacgcgtgctgtttgcctgggcgcgtaacggtcatctgttcaaagtgtttggtgaagtggatgcaaaatctggcgtacctcgtggcgcgttgtggctatcgctggtgctggccattgcctggacgctgccctctgagtttcaggtctggggcggattaattggcgcagtaacctcggcaacggtctttacctacatgcccggcccgataacccttggcgcgttccgtaatcacctgcccgatatgcagcgtccgttccgtctgccagttgcggcgtttctcagtccgctggcgtttgtagccagtacgcttttgatttactggagcggctggtccgtgaatgagatcctcattccgattctgattgttgcctgggtcgcttatgcgatttttggtaaaaagaacagccagttcagtcaggatttacggtgcgcatggtggctgctggcttattacatcgcggtaatggtgatttctatgctcggtacctacggcggaagcggggcgattggtgcacccttagatatgatcctcatcattgtcgcgtctctggtctgctacttttggggcgttcaagccagcctgtcgaaacctaatattactgatgaggacgatgaatccgcctcctttggcaaacacgcataataacgtttatcgcctgcacctgtgccctggcacaggtgctttcccgcacgccaggagacagcattagcgcatgtcggcacttgccgggcatggcgcagtcctgtttggcagaaagaaggcggataacgtggtgtacatgcagagggcgcattatcgctatgatcaaaatacctgcgcatcaacccggttagcgatgggaacgggggattccacgagtgacgatattggggatgggctggcgtaataaagcagactggacaggccgtggataggcaaaaaatgatgcacggcttagcgcgcatcatgtatcgaaattagtcctcgttgccccactgattcaggaaggtcgctatctcatcaatgcgctgttcattaatgcccgcttcaacggccatctctttctgagcgtcttcgctgatttcttcattattcattaaacggccaatcagcaactggaaatagtgcgccagcgcgtcacgttcagattcgcttaccggcgtttccgtttccgacgaatactcatcggcaatgtcataatatttcagtgagacttcattgttcatatcttgccctcagggtgacgacctgtattttttgactgaatcgaatggggtaatcatatcattcatatagcgatttttctgccagttagcgctgttggggcggaaaagtcagtagcacatgggcatgagcttgtttacatatgtgtggccaggcacggaaaaggggggaagcgctggatcaagcgtgatgggcgtagttattgaaaaggtcgattgctactgagaaggcagtactgtccaggtcaaccagacagtgcgccaccacaaagtggtgtttatcatgaagacttatccagataggggaaaagaaacgtctcgaccgcctgttttccgatacctgatgtaaggctgatacccgcattttttaaaatattgagtcccgcgcctctgtttttagggtgcggatcttccatggcaatataaatgtgccccggctttagctctgcaagcattaaagcacaagagggcgttctgccctgaaaagagcagggttcaagagtgacatatacttcgcattcgctaatggggaatgtaagctttgtgagcgcatcgatttcggcatggtggtggcctggtggatgtgtaaaacccttagcaacgacaacgccgttatgaacaataacgcagccgacagggggattaggtctgcattctggcaatgcccggcgggaatattcaagcgccaacatcatgaatttgagcttttcttccatatgattttatctgttgaatgtctgggatctaaaaccagcaatctttaaggctactgttattaatgtccagccatttcgttgactcaccaaccgcgcttagttcggatgagtgagtcattattattaatttctgaccctgtgttttatgtttaacaggcaaacagtttggattttacttgttctggtaaagatcccaacggttgccataaatatcttcaaataccaccacggtgccgtactcttcttcacgcggttcctcacagaacgtcacacctttggctttcatggcattgtagtcgtgccaaaaatcgctgctctgcaggaacagaaaaacgcggccaccgcactgattaccaatagcgctctcctggcgctcattggaagcacgggccagaagaagattgcaatcgctttccggattgggcgtgacgactacccagcgtttacccggctgcggtgtgtcttccacaagcgtaaagcccagcttgtcagtgtaatagtcaatggcgcgatcgtagtcatcaaccacaatggcgacataacccaggcaccgtttttgggttctcattttttgctccgtcagatttcaggtgaagttgcccgataaagacatttaccataaacggccccctttttctgttgggatcgtttcactctgttgaggccgagttaaacaaaaccccaaagtccagctcaccctgacagcgataaccgctactgcataacccgcacacgcgcttttacagatgacaatctcgtcaggcttaacttcgggggtaatcatcggctcgacgtttcacccagactgacagggatatgataaaagccagagaagacaggctcgtccagcgcagggtcttgatattttgtcagggtgagcaggtcatattcatctcgtcgcacctcagcccttgcagggagaattgactgatatatcctggccttcatttccatcagttgcatgacctggcctttaaaagggaacgtcagaaaaagccggtctgtaggcgcactgaaggggaaaggatcgcatcctgccgctgaatgcttgctgcacgaaaaggtctgcataatcactacatattgcggacgtgcggcgggcagttttttgagccgtcgctgcgccagcggctggcggaccttgataaaacggcgagtatggctgaaagggtacattgcatcttgctggagagtttgcctgctggcgaaaccgcaatgcagacggtctgtcgcaagctggcagtcagctcacggacgctgcagcgcaaactgcagaatgaaggcacctcgtttcagcagatcctcgacaaggtaaggcaatctctcgcgatacattatctgcgcagtaccgctatgtcgggtgcggaaatttcgttcctgctcagttttgaagacgtcaactcctttgccagagcgtttcacgcctggacaggaaaaacgccccaggcagtgcgaacggctgattcgaccgaggttatgccgcctgcggaagatgaaaaagattaacgtgggtgctttttgccggtgaagcggcaaagcggatatgacgggccagacagaaggccgtttctttcttcaggaagatattttacccgttctggcagacttacatcgccagacggccccagatcccgttaaagtagtccggcaggcaggtcagcctgctttatcacaagtgaaaatatctcatcatacaggtaacgtcggtcatggctttgatccccaaaaactatacgcgtctggaaagtggctaccgtgagaaagcgttaaaaatctatccgtgggtctgtgggcgttgctcgcgggagtttgtgtattcgaacctgcgtgaattaacggttcaccacatcgatcacgaccacaccaataatccggaagacggcagtaactgggagttactgtgcctgtactgccacgaccacgaacactcgaagtacacggaagccgatcagtacggcacctccgttgtggcgggcgaggatgcgcaggacgatgtgggtgcagccacctacaatccttttgctgatttaaagtcgatgcttaccaaaaagaaataacgctgggtacatcctctgcggacagatttcggccgtcgttatcagcgaaaagcgcaaggcgctgaaacctgtcccacgctgtgagcggggcaggcggcgagcctttattgccctttttcatgcagggcattgttgcccgctttgccccggtcgctctgctgggaaagcggcgcgtacagcacccgcaggacgacatgaagaaggctcatgttgatgtgaaattaagtcgctttcactcatgccatgactctggcataaaatatgcttattgattaccgacgcgttgaagactgccgaacacgcaagccacaagacaaaagcaggccgttctggcgaacaatgcagttttcacatcagaattcaggatctaaaacacgatgaataacaacttcacatttacgattaagagcagtgtttttgatgagaattacaacccatcagaaaatacgcgcatcaccaccaactttgctaacctggcccggggtaagaaccgtcaggataacctgcacaacgccctggtgatgattgataatcgtttcaattccctggcgcattgggacaacccaaaaggggaccgttattctgtcgagcttgagatcatttctgttgaaatgaatatcaatgtcgaaaataatcgtgatgccttcccggtaatcgaaatattaaaaacaaatatcgtcgataaaaaaaccgatgagcgcattgaaggtattgtcggaaataacttctcctcttatgtgcgcgattacgacttcagcgtattgctgtcagagcataacaaaaataatcccgtgtttaacatcccggataactttggtgagctgcatggcaatatctttaaatccttcataaaatcagaagcgtacaaagcgaattttagcaaaacaccggtgatttgcctgagcgtttcaagcaaaaacacctatgtgcgcaccggcaaccgtcatccggtactgggcattgaataccagcaggatgaatattcactgaccgataaatatttcagcaagatgggcctgcatgcacgttactttatgcctgaaaacagcgttgcacctttagcgttttattttacgggtgatttgctgcgtgattacagcaatcttgaactcatcagtaccatcagcacgatggaaacgttccagaagatttatcgtcctgagatttataatgcaaattctcctgcaggtatcgaatatcaaccgagcctgagccatcgggatttttcattaacgcaaattgtttacgaccgagaagaacgtagccatctggctattgaacaagggaagtttactgagaagaacttcatcaaaccctacaaacatgttcttgagcaatggtctgctaattacgttctttgattaactcagtataaggttatctgttatgaaaattttgttaccgacttcgacggcgggaagcctgcctaaaccgtcatggcttgcgcaacctgagacgctgtggtcgccctggaaactggaaaatgaagaactcatcgatggcaaaaaagacgcgctgcgtttgattcttgacgatcaggatcgcgcaggtatcgatatcgtcagtgatggcgagcaaacgcgccaacactttgtgaccacgtttattgaacacctcagcggtgtggattttgaaaaacgcgagatcgttaaaatccgtaatcgctacgatgccagcgttccaaccgttgtcggtgaggtggtgcgccagaagccggtatttgttgaagacgccaaatttttacgtcagctaaccaataaacagatcaaatgggcgctgcctggccccatgaccatgatcgacacgctgtatgacagccattacaagagccgcgaaaaactggcctgggaatttgccaaaattctcaaccaggaagccaaagaacttgaggcggcgggtgtcgatattatccagttcgatgagccggcatttaacgtgtttttcgatgaggtgaatgactggggcattgccgcgctggaaagagcggttgaaggtcttaagtgcgaaaccgctgtgcacatttgctacggctacggcatcaaagccaacaccgactggaaaaagacgctgggaaccgagtggcgtcaatatgaagaagtgttccctaaactgcagaagtcgaacatcgatatcatttcgctggaatgccaaaactctcgcgttccaatggatcttatcgaactcattcgcggtaaaaaggtgatggtcggggccattgacgtggcaaccaatgctatcgaaacgccagaagaagtggctgatacgctgcggaaagcccttcagtttgtggatgccgataaactttatccgtcgaccaactgcggcatgacgcctttatcccgccaggttgcccggggcaagctgagtgccttaagtgccggtgctgaaatcgtccgcaaagaactgctgtctaaataatcgcgccagtcgtcggttaggtaaaagcacatcaacggagacctgatcggtgatcgggtcttttttttactcaccgggcgaggttgtgcctccccagcggcaggctgcgtaaaggcgataagggctagcggcctttcctgcgcttccactcatccacaacgtctcccagatttttggcaatatcattgcgtatccacgccatgaactcccgatcaaaccggaatgtctccccgcattgcgcaaccataaaacgacgcacgttttgcgtgttcttatagtttttatcaacgatcgtcatgcgagtcagttccgcgctgtgccagtcaatgctcattcgcttgcctcatgtaaaacggggtgaaagagtaacccattgtgctgcacattgctcttaggtgatcacgctgacgggacgtttatgcctggcttatcatcttccgatatgcggcaggcgtaataccggtcaggcggctgaatacccggcgcatcacgtctgttcccgaaaagtcgtattcggctaccagcttcttgatgagctttcgatcctcattgcccttatgggacgtttcgtcggtggtggcattatgctcggaaccctcagcagtaaagctttggtacgaagattcacggtggcacatcttccattactgatacacgacatgctcttgatttccggggcagggtttttgtacagagcctggcaggtaaaataactctgctgcagacggacaaggctgacactttcactacagccaatctgattggcgtttctcgccatcaggattttatcaggtggttgcgccataacggtgaagggtaagccatgctggtaacgtccgcttatggcgcaaagcggactgatgtcaggttaatgtctgctatgcgcgaaaagcggaatttagtcgttgcttcaagtgaccatgaagccatgccgaaacgctagtttgcagacgctgtaggtcttatggttatttcagatgtattaacggtttcaggcgcctcaatgacatgctttacagcatgggcaatgtcagcgggtttaagtgcgacagaacggtaggcatccatcagcgccatggtttcctcatgggtaattgttgacgcgagttcactttctacaacgccgggatttaagcaggttacacgtatgttaggactttcctgtcgtaacccttcagaaatagcccgcaccgcaaacttggatgcacaatagacggcagctgttggtacgacagtaaaggcaccaatagagccgatattaattatctgacccgatttctgtgcttccatcacgggtagcacagcgccaataccccaaagcacgcccttaatattaacgtctattgttcgttcccattcatcctgattgccagcggcaaggggtgaaagcggcataatgcctgcattgttaataaggacatcaatacggccccagttgtccagtgctgtctggacgaagtcagacatggattgtcgatcggtaacatccaaagcccgcgcatcagcaataccgcccgcgctgcaaatgtctgctgcaatggcatcgatacgttccactctacgtgctcctagtaataccttcgcacctgcagttccaagttctctggcaataccttccccgatgccacttgatgcaccagtgattaatataactttgtccatgatgttctcctgtcattgatttcggagagagaatagaactttacgataagttgcagtatcctgctttcactggactcagtggttagcagtactaaacaatgaaaattgatctcaatcttttacctgtttttattgcggttgcagaagagcataatttcagtaaagctgcagcacggctgggcgtgacccgttcggcggtcagtcagggaataagaaggctcgaggatgctttcggcacaatgcttgtcatgcggacgactcgctcggttcatctgacggaagcgggagaacagttgcgtgtatctctttcattgcctttaaccagtctcgaagctgcattcgacaatattgctcctgacagtaagccaagaggacttctcagaatcgcggtgacctcgatagcggaagaatttctttcaggcccgttaatcgcttccttcgcggcagctaacaccagtgtgaagcttgatattgttgtcactgataaagagtttgatattgtggctgcaggctacgatgccggtgtcaggctcggagaagtgattgaaaaagacatgattgctgttccgcttacgggtgatcaacgtgaaatggtggttgcttccccttcctatcttgcagccaatagtcgcccttatcatcctcgtgagctggttcatcatcagtgtatcggctggcgctcatccccggatgttgagccctatcgctggccatttgaagaaaacgggagagccttcgatctggcgattgaaccgcatattacgactaatgacctgcgtctgatgttaagactggctctggctggtggcggcatcactatggctactcaagaaacattcaggccatatataaaaggcggtcagcttgtgtcagtgctggatgagtatcttccacaatttccaggcttctatctgtattttccccagcgccgcaatattgcgccaaagctccgtgctctgattgaccatatcaaagaatggcggcagacgtttacttgccccctctgagtggttcatttccattttttgaatcagtgagttagttcagggtaaaggctaagattagcgcatgcagatgctgcggacttgtccagtattacgtgataaagcatattttcttcactgctccatgcacctttgcaagctgtcctgttgtcctgcttaacttcctctatataacgcccatgtcctgccaccttatttctacaaactcctctgatagatgaactcaggttcaattcagactgcggattttggaaacaaacgcttaaatcccggtagctaccatgacggtgggttcgccagttatgtctgctaagtccgcttctggcacaaagcggactgtgggtaggtgatgtccgctatgagtgaacagctgacgtttcgttcaaaatgactgacaccacattcgacggggcatccctaaggtatctcatccgaaaatcgtgcggtgatcgcatcacgttcataaccctgcggttgtgtcagaatctggtataaatcaggacgacgaccgtggatccagcgacgtccggtactcatggcaagcaggcttaaatccagttcagcgctcaccataacatcttcaaaagcccaggtttcattaatgattcttccataaggatccaggatcatggcattgcctgttcggacttcgtcatcatctgcgcctacaccgttactaaacagaagaaataacccgttgtcgtgagcacgggcaggtagccatcgcatcagccattcccgaccgcttgcccccttaaatgcagcagtaatttcttcttttcgcgttttccgttctgcccagagtgacagcggaatgggtttcatcgcataggggctgcgggaatcggtaccgcctgtttgatgtggtgcaagaaggatatctgcaccaagcaatgccgtagcgcgcacattttccaccagattattgtcccagcaaatcagaattcctacttttaccccccagggagtatcaaaaacggtgaagcggtcaccgctgctgatggctggatgctcgaaggcatgaagtttacgatgcgtctgcattgatccgtccggcatacaggcaacatacgcattataaaggcgaccatcttcggctctttcaatgagccctacgccaataagcatttgatgttttatcgccaaagagtgaactaacatcagggaagggctggttgcaatcggttctgcaagagcagaaacctctgcggtggtgagcttgggtacatgccaatagcctgtgatacacatttctggaaacgagaggatcttcacctgctggatggctgcctgttcaataaatttctcaattatcagcagattatattttttgttattggcctgatgctgaaactgtacggttgcagcctttaagaatgtaggctcgcgcatgatgcttctccagttgttgtcgaaactgaattacataacgctttccgataactgtataatcaaatgatttccatttccgataaccttttggaatgaaaaaattgaatatccgtttgttaaaagcttttttgatactggctgaaagaggaaattatgccgatgcggcacgggcactgtgtatttcgcaacccgcattgaccaagcaaattaatcttcttgagtcgacggtgaaggtgtcacttttttcacgcgggcgtcacggcgcaacgctgaccgccggcgggagacgcttactgccagaggctgaaaaagtggtcaggcaagctcagttgtttatgcaacacgcagatcgtgtatcagtcggtattgagggccatatagccgtcgggtttggcctctcaagcttttatctggcaccacgctgtattgctgattttcgcaaagattgtccgggaatagagatgtctttaacggatcttccctccttcttacagtaccagttactgcaaaatgatgagcttcaggtaggatttgtcagggtacctccaccgatagcgcttgattacctgccattatttacagaccggctggttctgatagcacctgcaacgccgtcgttatcattgtctgctgctgaatggctaaaaaaatatcctttgttacgtcttcatactgaacgagggcagggtttaaatgcgcagattgaccgctttttgcatgataacggtctttttatatcatccacccaactggctgatgatatacaaactattgtcgcgttggtgatcgcgggtacaggcgttgcaattttgccctatagtgttctgcatatcgcgccaccggaacgggttattattccgctagaaggcaagtcaataagctggaatgttggcatagcctggaacgcaagcacggagaatgtcattcgcgataattttattgccagtataagaacgcgtattgcggtcgaaacgagtaatcagctatagggtttcattccaggctgaagctgaacaacgctaataatcgactgattcatgcgtatgttggcaacgtccgctactgcactaagcagacattgtgttcacatccccattagggctcgaatttgtctttcgctggcaccatatcgggcctgtaaatccctgacccaatcccgcagtcgccccagcgtcagctcttttttgccagtacatcctgcagcatcgccttttcggggcaccagactctttagccgcagatattcctcttcccgctgccgcatatagttgagttcagaaggggaaactccgctgtatttctcaggccatgattaaaatgtggccagaaattcaagtcataaatatagtattgtgatttgtgtcactaaatattccgtttcgcaaaaaaggtcattctaaatgacaacagccgacatgcctcgcaatttaatatgccattactatgatggccggacagtttaatctcatttaagtttttgaacgcacttaaaaatagacactgatggaatatcacatgccaataaatacagctgccatgcaagaaaaactattaagtttaatgcaaagcgttggtcaaaatatctacctgaaatcagtgatgagcggcatgatgctcgtgttaccagcaaccatcatgagttccgtcgccacgcttcttaaggtattccctttccagccctaccaggattttcttgttcgctacgaactagtaaggttttttgatatacctatcaatttcaccaacaactttctggcagtcattgtttcattttcggtagcttacacgctggctaaaaacctcaatgttgatagcttcatggccggtctgctttcaatgatttcattctttatacttacaccctataaccctggagagatcggtccactggggcaatcatatttaattccaagccaatggttaggcgccatggggttgtttacggggattttggttgccattgtatcaacccgtatttttacaggcattacccgaaagggattaattattaaaatgccagagaatgtcccggattttatatcaaaatccttttcatcgctcattcctggtattgtaatcctgacaacatttactgttatatctgcggttataacgattaatggttatggtagcatccatcaaatcatctataaactcatccagtcgccactcacatctcttggatcaggcattggatctattatttttgttgcagtgcttgctcagttactctggttctttggtcttcacgggcacgccataacgctaggcattgtagcccctatatggtttgctatggatgcacagcagctggctgcgtatgctgcaggcattgaattacctaacatcaccggttttgcattctttatgacctatggtgttgcgggcgatttattaccattagcgattatgttggctttttttgcaaagagtagtcgatataaaactttaggtaaaatagcccttcctcccgcggtattcacaattggtgaacccatggcctatggtgtacctttggtcatgaactttgctttagctattccctacatccttatcaacgggattatgttgggcatcgcatattatctaactgtaactggaatattgccgagggtcgctggcgtcagcacgcctgcggggatgcctatcataatctcaggattcatgcagggtagctggaaaatagcggcattccagtttattgggttgtttgtaagattttcagcctggtacttcttcttcaagatagctgatgcgttagcctgtaaagaagaaacggatgaaatctgtgcgagttagataatcaaaatctggaagttgaccatgagaaatacactacgccacggtgggttaaatgttgcaaattaattatcagaccagtcgaattgttgtcgacagactccctgttgcatgtcactggagcgttaagcatatacaaacatcgtaccatgtaacaattttaaaagacgataccgtggtgcatgaacttactggggttggcgatagcacagatctccttttaactggctttgagttgagtgagtacggcacatatactgtgaagattaattcatgcaacagtgctggtagtatggtttcactgagtaattcattcattacgggtaatctgggtaacttccacggcaactggatagcaaaaccttttcagaacaataaagataaacccgaagatagtagtgcgcgaaacacagttctcaggaaatgtttccctatccaaaatgcaatcgatagggctgtaataaacattactggccttggattctataacctatatataaatggggataaagtatcaaggaatgaacttaataccgactggactaattactcgaaaaccgtctattacgatacctatgagataaaagattacttaaaaacaggtggcaatactttaatcattgaactgggaaatggatggtatgctccctccgaaatgaaactattcgggaagtataatcttcgtgacatgttatgttcaggggtgactcaggcaatcgctgatatttttatacagggtgaggaactgtcagtacgtctatcgacggatgagacatgggaatgcactgaaggcgcatattttaccaacaatatctacctgggcgaaaccttagattcccgattgttcagtggtcgcaataccacagaactggtatcacccagatggaataacgtcctcctggcgaaagggccacaagggcagatggtgtccagttatatccccaagatagaaaaaattaagtgtctggactttaaagaaatccatgttctgaatgaatcagaattcatcgtagattttggggaaaccctttctgggcttattgacctttcggtgagcgcctccgaaggacaagttatcactctgacatatgctgagtgtctcgacgatgattacacgttgaataccgggtcaacgctggctggcttcattggaaaagaggtagcacccggcattgttataaatggtggagagtcatcacccggtcgtgcagagcaaatcgaccagctcatttgtcgaagtggcatcaatcatctggttaacaagtatacctatcattcttttcgctatgtgaaagtgagtggaatgaacctggatcagttactctgcattatggcgcacaaggcatacagcaaactcgaaagcgccggcgattttctttgctcagacttgtatttaaaccggctgtatgagattgcgcgtaataccaaactaaacaatattcactccgtgttcagtgattgcgcgcgggagcggtttgcgtatggtggggacatcgttgctctggcaaaatctcaggtttatcagtttaattctgcaaagatgtacgaaaaaaccctttcagactttatcaacgacacgcggaaaaatggtggttttcctgaaacggcaccatttgtgggaattaaaacaaacggaaccggggaaacagccggccctttgggatggcagcttgttgttccctttttgcttaacattcattaccagcactatggaacgctggatctcgcacgtgcgttttttccattcctggagcgtcagcttgaacaccttaacagtgtcgggtatgaagggcttctcgactgctgcctcggggattgggggagtcgagattctggtgccgttgactataagtctggttcgcccgctcgcaatttcacgaccgcatgtatctattatctgcatgtaaagttactccataaattcagcactattcttagactgaacggtaagtctgaattttatgcgaaacaagcacttgaaatcagggatcgtattattactgattttcgaaatgctgatgacagctttgcagataaaagtcagacaagctatgtttttgcactctatatggaattaagtgataaccccaaaaagttagccagtgaactggctaatgctatccgcgataataattacctggtaacctgcggaatttttgggcaaagcttcctgtatgaagttctccgtcattatgatgaaaatgaagtaatcatgaaatggcttcacgcctgtgggggattcaaaagtatgcttcatgacgaggatactaccctgaaagaattttttggtgataataagaatggctcatgcaatcatgcgatgttcagttcttatactagctggatgactcaagggccaggaggtattattattgaggataatgcaagaggtagtgatactgtaagaatacaacctgcatttttggattcattacagttcgtcgactgtacacatcaaactgtgaggggatacatttcttgcaaatggcaacgtcttgcaaaaggtattgaaatagtgatcaatattccatttaatttaaaaaaatgcattctggttatctcagaagagtataatgtcacgggtaacatccatgaacctcagtattccgatggtgttaatcaatactttgatatacgaaatgctggtgaggtcagcgtgttactgacctgaacgcttcattaattaaaagctccatgtaggtgttttatgatcaatcctgaaatacatgacagtctgttagcatatacagagagagaacttgagattttacgtgctaactatcagctgagtcataagtttaagaaccgcatggagcgtaggttttttaaagataactatatttatattgaaaaacagactcgtttcacaaaagtgtccttgcattcacatgattttatagaactcatctatatctatcaaggaagtatgcgtcaaaatgtcaatggcgtgcccatgacattacaggaaggggaaattatgctcctcaaccagtttgctaaacacgaaattgattctgccggccataacgacatcatcattaacttcatcatcaaaacggagttttttggcaaattaatgtcgttgtttgatgaggataacctgatatcggatttcattctcgcgtcaataaatggtaagcgtcgttatggggaacatattcatttcaaagtgggtgagatagattctatccagaacattatgcacatcatcattactgagatttatagcgcaaataaacttagagaggtgcgcgttaattttttagtgggtttgttgctgaccgaattacttgcaaatattgagtgtagtgactatcacattaatggaacttacaataattcgatatcaacatctgtcctcagatatattgatgagaattataaagttgcgacacttaacgacatttctcgaaggttaaatcagccgaattataaggtaagcaaattactcaaagacttcaccggaaagaactttagtgaactccttattgaaaaaaggttggatatcctaacgcatttactaaaaaacacaaattattcaataattgacgcaatcaacatgtccggttatgaaaatgccactcactgctataaaatattcaaaaataaatacggcatgagtatcaaggaatatcgcaatagttttaactaaccctctttccctgttcggaaaagtcaggcatttttgtctggctttttttaaatttaatattgaatgcaaaattcgacatacaaaaacacaagcctggttataactctactttggcggtcaaatataatggttgtgatttcttttattattaaaaaattaccctaccattaccagtggagctataataatgtgtttaaataaaataacgctttatttattgctgttttgtagttgtataaatgaaagctattctgcaaatatttctgaggatggctcgtttcaattaaatggctatggaatggttgccggcgattttcagagcgaatacaacagacccaaaaacatgacgcttcatgcagatcccactggcccgaatcaggacccgcgaggaaaaatgggggatctcggtaacagcttttggcacgattattatacgtcgcttgccgttaccaagaaatggacagggatcggcgcgcctgaacagtgggctgattacacttatcaggttgtagggtacggagataaagctcttgaaactgcacaaaactatgggagatttggtggactgaatttcctgccagatgagtcgaatatctgggcgggccgccgctatctggacgagcggatcaatgtgtttgcctataatactaaagaagttcacattgattcaggaataggttacagcagtaaaaattttgattttgctgtagggaccgctcagattgactggtcaagctctggcgcgccgatggccgcagaaggttcacgccggattttcgacctcacttatcggctcggattaacagagtggggcattacttatgtcaaagaactggataacccacttggtaccggtgtacagcaggccacaagtttctcagctaaatacactatgccaaactaccttggcctgattaaaggtcaatcttcactacaaattcagtatggcaaaggcgttatagcgcaatacctgaataccagccgaataagtgtactcagtgagaaaggggattcatctgtcagatttactgtcgatggaagcatttcacaatttgaagattttaccgtaaatcccgcttttatatatgaatataccaaacgtgataagtctgcagaccgaaccacggttatacccgacctggcttattctggtggcgatatgatttatggctacgaaaatgaaacggggatttttggtggcgtaacggtaaaacaaaaccttcatcatcagaacatttcaatgctctatgaatttattgtaaacaataccaaaaacaagaatggggtcgccggtgctaatggcaatgcctacaaaatttcagtaggtccggctcttcaactggacgtgctcccttatatcgcaccacttgccagtctgacattgacctacgccgggggagatcgtgaaataaccctgttgccaaaagcatctgaatggcgagtgggctatcgcatggaagtctggttctgacggtgtctgtctttaacgctattcaggagtaaaaaatgtatagaaaatcaattgtggcattgaccgcattctttaccttatctgtttccgcagccggtcaggtagcagaaagtaaaaatatcaaattaacgccaaatgcactggctgttgaaatgatccctgatattacttactcatttacacagaataccatgggcaggcctctgcaactgtcaatggacgttcttaagccttactccccaaaaccgcttcctgcagtggtatttatcaccggtgggggatttattgatgcaccgaaatcaaagttcattggccaacgtgtcgatatttcacgggcgggttatgtggtggccagcataaactaccgggtagtcccgacaatggtctttccaggcctgcttgaagatgctaaaacggccgtcaggttcttacgcaccaatgctgacaaactgggtattgacccttcccggatcgccgtgatgggtgagtcagccggcggctatctggctgcaatggtcgccaccactaacggcatcaagacgttcgatacgaccgaatattccgggcaaagcagcgatgtgcaggcagcgattgatctgtatggcttatctgatctcaccacggtcgggaaagatttttctgatgaaattatagaggcgcacaagtctcccgctattccggaagcaatgctggtcaacggcattccgtggcagggcggagggtccattctttctaacccaggcaaggctaaagcggcaaatcctataacctatatctccgacaaaaccccgccatttttactgatgcacggcgatgccgacaatgtggtgtcgccaggccagacaggtattttgcatgaggcgcttattgcacatggacgtgattcaacgcgttatatcgtcgagggggccgaccatgctggtttgatgtggtatcagcctgagataaccaagatcatcattaattttttggatacccatttgaaggacaaaaaataactacgggtaatgccggatcattcccgtgataaaaacgaattgcaggtcagttgcactattgaattgaacatattctggggattatttcactggttcagtgaaaatctcgattgtaaaaaatagggagttaacttgaaacgtatctttttatgttgtgctgccggtatgtctaccagcatggtgatgaaaaaaatgaaacaggctgcagaaaagaacaacatcgaagtcgatatcgttgcggtttcgatggaagattttgatcggactctggctctgtatgactgctgtcttctgggaccacagatcaagtataaatttgaggagtttcaggctaaagccatatcagcgggaaaaaaaatagcggtaatcaatagcatggattacggcatgatgcgcggagagaaaatcctcaatgatgcactggctctttttgaataacgaacggtaatcatcagcaataacagaattgaggtagcaaatggatatggaatcaacggtaatggaactcatcatcaatgcaggtgagtcccgtagctgtgccatgcaggcccttagcgctgcaaaaaagggtgactggcatgaggtcgaagcgcaaatgaatgaatcttttgccgcatctaagcgggctcacgacgtacaaacaatgcttattggtatggacgagggatgcggcaaagttcaggtaaatctggtcctggttcatgcgcaggatcatattatgaattcgatgttagtccgggaaatggtccaggaattcattgatatttatcgccagcttccagcgcgttctgcatagcctcacgcttttgctgacagatctcatctattgcgtccatataatatggacgcttattgattaacgtccgctgctgcacaaaacagactgaaccaggaaaactgtccgccatgagcgacaagcggacaatattaaccctgtgtgatggcggaaaaaatgtactccaggacgtgcgctctagaacctgagcgtagcggttgcggtaatctgtcgctccgcgccgtaaaaacacgctgttgtggcgtagcatcctgcgacgtaattcttatcaaagagattgttaacgttcagccctatggttgaacccggcatactgaatctgcccaaatcatactgtatgacggcattccagatcgtgtagggcttcactttaaaggagtttgcgttatcaccttccgtagacccgatataccgactgcctaatcctaccgtcaatccgctaagagacgtttcatggaaagtatagtttccccataatgccgccatattttttggaatttcagcaggacgattaccttgatacaacgtatctttggtatattctgcatccgtgtaggaatagctgccgataatatcgacattttctgtcagcgctgcttttgtctcaagctcaatacctcgggagcgttgctcgccattttgtattgaatataaaatatgctcaggatctgaactcagatttttatcttttgttaactgaaataccgacaaggttgcggaaatcaattgattgtcaggaatatattttatcccggcttcatattgtttggcgcgagatgcctggaacattttacctgtatagtctgatcccgtggttggcaggaaggattcactgtagctaatgtagggtgaaataccgttatcaaacaggtagttcaggcctccacgccatgtaaattcattatcatcctgtccggcggaggtattgttagtaagacgattgacgctgtctacttcagaccagtcataacgcccacccagtgtgaatacccagtgattccattccgcctgatcctgcaagtacaggcccgtctgttgcagatgatcgacctgatcccggtaaccgaaatactgcaccgccgtattaccatatacaggattgaccagattcagactggacgctatacccagcgcctgccatacatcattacgcgtgcgccggtaatccacgcccataagcaacgtgtggtctacctcataggtggaaaacgtatgttgcgcctgagtatcaacagcgaaggtcgacaaatgctctttagccttaagcgcacctcgggtcagttgcgacggatcaaagggggaaatctggcttccaaagattgttcggtaatccatatctaccgttccgtagcgcaggttctgtcgtattgtccaactgtcattgatttgatggtcgaaggcatagccgactaacttctgtttacgggaaattttattatagcccggttcaccatcgttaaaactggtgggtaattttccacccgcgccactggttaccgttccttctttaggcaggtagccaaaccatcctgtatcgggttcatcgagaaaactgcttaaaaaagtaaactgggttttgtcgctgggacgccatgtgaaggacggcgcgatagaataacgcttggctttttcacccgtctgttgctgatcctgatcgctggccacgcctgtcagtcggtaagttaacttattgtcgtcatcaaccgcgccgccaaaatcaaaaccggtctggaaaagattatggttgcctgctttaaactgcacttcgcgaagggtttccggtgtcggacgcttgctgaccaatgcaataatgccgctggggtcactcaggccatacaggacagaggcaggaccacgcagcaattcagcgcgttccagcatataaggatcgacctggaatgaagtgaaactgtcactctgcagtttgagtccatcaagataaatattatcgccgacctggctgaacccccggatattaactgaattaaacccgcttactgaaccgcgactgtcaaccatcacatcggctgaataacgaaaagcatctttcagtgtctgtgggccgagcaaatccatttcttcacgcgtgacaacggtaattgactggggggttttacggagtggcgtatctgttttagtggctgtcgcacttcgttttgccaccacggaacctactggtccccaggcattttctgcagcgttactctgcccatcgcttgttaccgtaagtgtatcctgcttaggtgaagccccgtcgctgtctgctgacagggcgggaaatgacagtgaactcattaatgcgctaatgatgaccgcacagtaacgtggaacaaggactcttcgtactttcatgtctgtatgcactcgtagggtttgaataaaatacatttgactgaaacgaataagcgccaggcccgcgcgcgccactttctaaaaaagaagtctgctttccatgacggtaaaccggccccgaacagcggcatctgcgccttctgtgaccctgttgtcaggcaacgccactcaggctgcgcatcggtgggaacgcagccgttatcgctgttcagcacgcggattcataacgtttcagtcgtaaaacatccaacacaaataaaaatcattctcatttaatagcgagaatgattttttcgatagcgaaacccagacataaaatttttcatttcagccaaaagtgacgagtttttcttttcagcgggggggaatccagacttaacgtcagaaatgatgtggttgatgtcgccttcaccggcaatatcgctacaacgaaatcagagaaacacctgaatgtttcttggcgtcaacgacggttaaaggccggcttttttccgccagggcgtcatgccactgggtatgaatgaagtgtgataaacaacaacccccaggcggaacaatccgtcaagaaaagggggggaacgtctgttgtctgggcgaactgaacgagcaagggatgacggatcaggctgtgcgtttaatccagataaattttgccaggcataacacctgctgcaaatttctctgttctttcaaaaaggtagcgtgctggcggcttgccgactgcttttcggaacatggtgataaatccgctggcgttctcatagccaagttccagcgccacggtctgaacgctttcaccgcgggttaggcgctgaagtgaaagaatgacatgtagctgccgacgccaacggccataactcatgccgacttcctgcagcatcagccggctcatgcttctttcactcataccaatgcgatgagcccattcgcttaaagaggatttgttaatgggatcggccagcatcatttcagcaagctgacgcagccttcgatcacgtggcattggcagatgcaggtcttctacaggcgctatagataattcatcaagtagggttgctatcaaacggctttcaggcccctctgtcgcatagagcctcggtaaactcgctgctttaagcaataattcacgcatgagtgggtttactgagagtgtgcagcaggttttcggcagcccaggcatcgcttcgggttcaataaacaggcaatagcattctgtatttccagaaccacgtgcagaatgtggcatgttgcccggtatccacacggcacattgcggtggaacaatccacatcccctcgtctacctcacaattgagcacgccccggacggaatagagtaattgcgacttacgatgttggtgtgttttattttcccagccgcgtgaaaccatggatgcgctcatggcaaaaacggcgcgcggaatgctgtcaatatcaggcataacaacagaatttagcgacggtcccagggacatacattcagccttaaggttgagcgaagcgtttttggcggatttaaacaacattatgaccaacattcgcaatgcagtctaaggggtatttagataattttattaaataagagttttggtttctttctgtgctgcgcgccacgtcactgacgtggctgtttatcggcgcgacatcagctctgaaaatttaattaactgattgacaggattattgctatgcgaattgatgatgctcattttcctattgtatggataaacatgaatgcttcgggcaaggacacggttgcgtctccgtttagtgagttcgaagcgttactggcgcgtaagacacccttcgtattgcttaacgatgaaggttttactgaaagcaaacatgagcattccgccgatgagatgaagctcacaacacgctggatgaaagctcacaaaaatgaattaagaacctttgttaaagcctccataatgattgagccaaacattgtcaaaaggacggcagccagacctttcgccgtgatatatgaaaagttttggggctatcctttattgatggtcccctcaaaagaagaggctttagcaaccgcaaaaacattactttaagcgagataaatccggttaaaacgcacaccgctcacaaccaacagtcgcaattaaaagatgaaatggcgactgcctttccgagcctcctctcaatccctgcatgtaaagcctgtgagcgcatttcttaagccgctgtctgcttctgaccgtcagcagacatccttcccaatacctccttttacacccatcgaaaataataatcacagcaatcgctgaagctatggccgcatgagtcgataacgcttgctcggctcatttttagtgccgaggagggctcacgaataccgatcgcgaacggatcggcatgtagccctcttttttttacaacaccagtacgtgcattccttttaataacaacggaaataacactatgtctgtcatcaagacaatgaccagaagcttaaccggttcccgttttgcaggggccgctcagcccgccgacgggattttcaactgtgaaagcttaccaacatcgctctctgcagcaggcctcagcaatcgtgctgcgggtattttgctgacgtttgtgccgccagaggcagattttcagaaggtcagtcaggtatggcaacgttttacatcggcggatctgaccgtcattacgctctcctcgaacggcgcactcagcgccagcggtaagcagaccacttactgcaaaggtgaagggcaggaaggcagttggctttggctaccgcgcaatctgattgcggagcatgaaacgcacatcgtcgatttgcatcttcatgacacccacacggcaagcgatcgcatcagcgccattcagcatgaactggccgcgctgaagctgcgtatgccgctctctgctgaccgcacctttgccatgatttactgtgacggcctgtcagcatcggaaggatttttgatgcaggcctggtataacaccggccgttttccgtgcctggcgattggtggctccgcaggcggacgcgcaacctttgatggcacatggattggcgtgggtggtcaggtgctgcagggcaaagccgttatcgttttctgccagatggcagcgggtaaatctttttcgcccttcaagagtcagaactttgagccgctgaataaaagctggctcattgcggaagccgatcccgttaagcgtacgctgacctcggtgttcaacccgcaggggcagcagcagcctttcacccaggcactggccgaacatcttggctgcaacgaacagcagctaaccgagaagctgaaagggctgacatttgccgttaaggtgggcgaggtgttttttattcgctcagtggcgaagatggacagccagagtgtgcagtttttctgcgatctggagtttggcgatcggctttatttaatgcgtgagaccgattttaaacaggccacgcagcgtgactggcaggcgtttacccagcgtcacggcaaaccggcggctgttctgatgaacgactgcatactgcgtcgcgcaggcaatgccgataagctgcacgatgcgcatttctttaaagggattcctgccgcaggcttctccagctttggtgagattcttggcgtgccgatcaaccagacgctctctgcgctggtgttctttaatcacagcgtcaatgccatggcgcaatttccagtggaatatgcgagctatgccgcgcattacgctcagcgcgcgttgcgtcgctgggaggcgctcaaccgagtgcagtcgggcgtgctggcccgcgtggtgaactatcagcaggagttagcgcccatcgtgcaggcgctgccggtgcttgaggcggcaacccagagccagggcgaagcactgatgatggccgaaagcagcatccgtgccatcagcgatatcgccaaagagagccagcaggcgcagagtcgcctgggcgaggggctggacgatctggaagcgatctccaatggcatcaacgttattacgcatggcatcagcaatatcgctttccagaccaatattctggcgctcaatgcggcggtggaagccgcacgggcaggcgaggcgggcaggggatttgccgtggttgccggagaagtgcgtcgtctggcgcagtcctccaaagagcaggcggaagccacggcaagcaatatcaacgatgcggtgagtacgatttcacgcattcgcgacgttgcgacaagcaccgtacaaaccgccacggatatggctgaccggagcattcacgctgccgatgcgattgcggtgatgagtgatcgcacccggcatgaacgggcaggtatggcaaagcagctggatagtctgcgcaccttaactgcgggcatggatgccatgcaggaagcggtggccgagctgaaagtcctgcaaaccctgtccacttctcgttaaggcagcgctggcgcagcggttataaacgcgctgcgccagccagtctttatcgtttgcctggcctggccatgtgatcgcttcagctgctcgttgacgcagcgcggctgtctgcaaacgcgggcggtgcgccggtttcttattgatggcaaccctcgcgcggctaaggcaaaccgttaacggcacgccagatgctgcacactttacagaaggacccgaacttgcgtcttacaccgttgcgctatactgtcacccagggccaatgctgcctgccgctcgcgtccgcaaggataaggtgaaagcatggtttttcctgatatcaaatagctaacaactcttgagagtcggggcagggtaatgcgagcgccatcgagccttgacgacaggagaacccatgttatctatcgaacaagccaaacaaatggcgacaaaactcaaatcttctctggcgcagcgtgacctcacgctttctcactcagccgccctggaaacagtggcacatcagttgggtttcagagactggaatacggcatccgccacattgcccgcgcaaaccccgccttcggccgtttctttcagtaaaaccatcccgatattaagaatttttgatgagcgcaaggcgcgagaattctatctggattttctgtctttcagtgccgaattcgaacaccgtttcgaacccggtttgcccttgtatatggggatagtcagaaacggcttacagttgcacctctctgagcatcatggcgatgccagccctggcgcaacggtatttattcctgtgcagaatattcaggtattccgggatgagctgcatgagaaaaagtacggctacggtcgcccggacattgttgagcaggattgggggcgcgtgatggaagtgcatgatccctttggcaaccggctccgtttctgtcagggctgatcggcgtggtcagcctggtcatagcggctaagcgggccatgtctgcgtcatcgcttcattgaacaggcgcgtgatgtcagtggctttgggcgaatggcggacattcgcccgcagcggcaaccagcgcgtttggtgaatttgtactcttgaatggctggaaaaagaaggagcgtgatatgcagtcagtccacctcatgggtgacggatatgaaccctatgtcgaacagaaaggggatacgttgatctactccctccctgtcgattccggttttatcacctatgaatttgcctttgagattagccaggacgatcttgatgtcctgctgtccgatgattaccgacgcgccgttctcgaaattacggcacatacgctgcttcagcgttcgacgttaaagggctatgaccgctttaccccgcacgatttcgatgaccttgttgcgaacacgcttcactcaacgccagaatgcctgcagacattcattgcgcaagtcagtcatgaacatcacatcggtatagaactttatgcgaaaaacatcatggaacgacgttctgcggcaaagtcgtgagcgctgaacaggatgtaagcctgctggccctgcgccacgctatctggccctgtgcgatgcccggcaatgccgccacagaccgggttttactttgaggatgacgcgatgacccctttttatcaatttcatgccatcagcctgcgtggcgaacgcatttctatgggtgattacgcaggcaagctggtgctggtggttaataccgccagccactgtggcttcacgccacaatacgccggccttgaagcgctctaccggaagtacgccgaccagggactgatgatactgggttttccctgcaaccagtttggtaagcaggaacccggcggtgccgatgacatcgcccagacttgtcacatcaattatggtgtgagcttcccgatgtttgagaaagtggaggtcaacggcgccgcaacgcatccggtgtttcgttacctgaaagctgaattgcccggcgtgctgggcgggcgtatcaaatggaacttcactaagtttctgattggacgcgacggcaaaccgctcaagcgttttgcaccgatcgctaccccggaaaaaatggaagccaccatcctgaccgctcttgaaagcaacgtgttgcgctagcccatcctgaaagcgtttgcgctaaccgggttatcgccgtgtgaagatttattcagcacggagcttgcgccctgctgggtatacgccgcggcgtcagcaaccccgttatctgcgacagaacaatggcaagcattgacctgatgcacatctccgctttgtgccagaagtgaactgacagcaaggtacagattgcaggtctctggcgcatcgtgctgaacaaggcccggcagccttttatgaattgatcagaggcgacgtgatggagatgaagatgaaaagctcggggtttcgggcgcaggtttttgagagagcaatctcataaaaaacctgatgaaacagcagaatgcgatcaagtattttgccgctgcacggtttctgtgtttaaaatgatagaaatctatcattccaggcggcgcaatgaaaaaaatatctatgtcagctgtggccagagcggcgggtgtcggcgtcgctacggttgatcgtgtgttaaacaacagagcctcggtcaggcaggaaacccgggatcgggttctgcgtgctgctgacgcgctcggctaccgggaagacctccgcaaggtgatgacccatgaagccgcggcggtcaaaagtgctgtgcgcaccggcttcattcttcttcccaatgattattctttttatcaggtgctttcggacgaaatcagtcgctgtgcacagggaaaactgacaacggaaccggtgtttctgtgggcggatattcatgatattgagaaagtagtatcctctcttgagtcactggcaaaacgcgttgatattattggcgttgttgcgctcgatcatcctcttatacggcataccattaagcagctttccgcttcaggcgtgcaaattttcacgttgttttccgatctgtctccctgcggccaggctggctatatagggctggataaccttaaagcagggcgcacggcgggatggtttaccgaacgcatggctgaaaaagacagtgtgattggcgttctgcttggtgaccaccgttttaactgtcaggaaagctgtgaaataagcttccgttcgtatctgcgtgaaaacagaaaagatgtcgtggttctggagcctttacagacgctcgaaagtatcaatgggggctattcagctgcctctcagctgctaaaaaataatcccatgattacgatgatctatgcgccatgcggtggcattgagggcgtaattaaggccatcgtcgagagtaagcggcaggatataaaaatgctctgtcatggcccgtttatcggtgatgagatggcgctcatcgaagcccatgtcgaaatcatgctacgtcaccgtatcgatgcagtggctgaaaagatcgtctcactttttatcagcaggcatcaggaaatcgatcgcaatcctgtctacgtgacactgcctttcgatctcatcaccccggaaaatatctaaatcccctggccatcaggcaaaggcttgtgctgtctggatttgatttaaaactatcaaaataatgatataaaaaaatcatgatcgctatcaaataactcactccgaatgattgccggtaataaaaaaccggcgcaatactgcgcgcagtgagtcaggcgcttgcgtctggcctgtctgtgttcatcagtgttgccgcatcaggagaaaaatcatgaccatgtccatcgcaactgcgccctgtagctggggcgtggacgatccgaagaatccctttcttcccccctggcagaatgtcctcaaagaggcccggcttgcaggttacaaaagcctggaactggggccgtggggatatttgccagtccagccagatgcgctgaaatcggcgcttgacgggtttcagctgaccgtcgtggcgggcacccttttcgacgatttggtgagtgaagagaacttcccggcaatgatcgcgctgactcacaaaatctgtcacaacctgagcgccctttaccaaaaaggcgagtctgtcggtcaggataaacctgcaccttatcttgtgattattgacttcggtgatcctgaacgtgccgccaccgccggccagtcagaaaaagccccacggcttaaggatagtgactggcagagaatgatcagacacatcactgttttgagtgagattgcctggaaagaatatggtgtcaggccggtcattcatccccatgcgggtggttgcattgagtttgccgatgagctggaaaagctggttcaggatattccccatacagtagccgggttgtgcctggataccggccatctgtattacgcgggcatggacccggttgctgcgctggatcgttactgggaccgcattgattatcttcacttcaaggacgtcaacgaggttgtctggcgtcgtgccatcaacgaaggcctggattttttcaccgcctgtgcgcagggcgttatgtgcccacttggccgcggtgccatcgactatccacaagtccacgcctttctgcgccagcggcattatcagggctggataaccattgaacaggaaagggacccgcgtgatgcggataccagcctgcgagacgtcacggcaagtctgcagtatctgcattcagtcggtttctgaggagaaaatcatgattaacggtattaaaccgctcgaaaaatcactgcgttggggcatggtaggcggtggcggaaccagccaaatcggttacatccaccgctcatcggcgctacgcgataacaccttcactttggttgccggggcctttgatattgatgctgcacggggacgcgcgtttggtgaagcactgggccttagcccggaccggtgctatgccgactatcaaaccctgtttgcatcagaagcaaaacgcgatgatggtattcaggccgtctcgatcgccacaccgaacaacacccactttgccgtctgctgcgcagcccttgaggccggtctgcatgtgatctgtgagaagccgctgtgttttacggtcgaagaggcggagcatctgtcgacactgagccgggagaaaaagaagatcgtcggcgtgacttatggttataccggtcatcagcttatccatcaggccagggaaatgattgcggagggattactgggtgacatccgcattatcaacatgcagtttgcacacggttttcacaacgaatcggttgaacagaataacgccagtaccagttggcgcgtgaacccacgctttgtcgggcccagttacgttttgggtgaccttgcgacccatccattatgtatcgctgaaaccatggcacctgccatgaaaatcaggcggctgctttgctcacgccagagttttgtgaaaagccgtgctcctcttgaagacaacgcgtttgttctgatggaatacgagaatggtgcggtaggaagtctgtgggcctcggccgttaactgcggctcaatgcatggacagaaagtccgaatcgtcggttccagagccagtattgagtggtgggatgagcagccgaaccagctccgcttcgaaattcagggtgagccggtacgcattctggagagaggcatggactatcttcatccagttgcccgtgaagatgaccgcataggcgggggacatccggaaggacttttcgaagcatggtcgaatctctacagacgttttgcgctggcgatggatgccaccgatcgcggtgacgatgccttcctgaacaattactggtatcccgatgtgcatgcgggcctggcgggcgtcagatgggtggaaaactgtgtacgttcagccgacgccggttcggtgtgggtagagtgctgaaatctctgccataaaaagtctggactcactctgtttaacagggctgaaaaagccgtagattgggtgagttcactgactttcgcggcctgaaaaccgacctcaggcgaggtcgcaaggactacacttcagggcgacctggtaaaatgagcatggctcgcatgttgcgcatgctggacagtgatcaggctactgtctgtctggtgccagaagcagacagtagcctttgctggtgattttgatagctgatgcccggctttaaaagaggctatcctctcggaggaacggcctacagctgctggagagacttgatgattgcctcattcatctcgtataccgcctgttcgcgccggcgatagtaggtccattttcccaccttactggcctcaagcagaccggcatcatgcagcgctttcagacacaaggatgtcgcgggctgtgagaggcccgccttgtcctgaatgagactggcacagacaccgtactgatcgaagggatagagctgagcatagtcagcaaaggcttcgtcagggtttttaagccatttgagcaccgcaacccgcgtaggattggccagtaatttaatggcattttcgggtgtcatgccgtcttcgaacctcaagcaggataaaaaggatagtcagtatagcctttctcgcttccgccatacagcgagccagcatccacctcgttcagcggatagcccattttaaaacgtgtcggtaaatccgggttagcgataaacgtacgtccgaaaccaaacaggtcgccccatcccttttccagcatgcgttcggctttttccttggtgtaacgcccagaatacataatgggtgaacggaaggtttcgcgcagcgcaatacgaaaacgttctggcagttccgggctgttgtcccagtccgcttcggcgatagacagatagcctgtttcgagcgcgttcagcatctcggcagcacgaaggtaagtggcatggggatcgctttcaaccagccccagataaacgcgctcttcctctgtgcttgagaacagcggcgcgaaacgtaccccgacacggtgactgccaaacactgaactcaccgcctcgacgatttcgcgcaggaagcgcaggcggttgtccagcgaaccaccatattcatcggtgcggaagttggtgtgttcagaaataaactgattgatcagataaccgttggccgcatgcagttcgacaccgtcgaaaccggcttttttggcattctccgccgccgtacggtacatcgccacaatctctttcacttcagaggtcgtcaacgcgcgcggcaggctggggtccgtcagcacaccggcaccaggcccggtttcgataaatacccgtacgccgctggcggcaacagctgaaggggcaacaggcggctgtttcccgggctgcagttcattgtgcgagacgcgtcccacgtgccagagctggcaaaagagggttccgccctcggcatgaacggcatcggtgacgtttcgccatccggcgatttgtgcttcgctgtggatgcccggcgtccaggcataaccctgtccgcgaggctcaatttgtgtcccttcggtcaccataaaaccggcactggcacgctggcgatagtagtccaccatcatcgtaccggggacgttgcccggctgctcgctgcggcaacgggtcaggggagggagcgcaatgcggttacgtaatgtgagatcacccagcgtcaggggcgcgaaaagagacgtcataacaactatcctgtgagaagaaacaaaggtgggcattatatttatacatttaaatttgtaaatgtgtaatttgtgcggttgtaccgcatggcccatgacgtcgctgtcgacacgttttaccgcgaccactatgcctttgcgcaaggcggggaggtttccatcaaaacgcatctgcttacgccgacagtttcatctgtttcatggtggcagcctgtgtcggcaactgaatacaggctgacgtccaggtgaaagcgttgcagggaggcaaagggatgcataaggcaggcattcataatcacgtaacgcccatcctctgtttgccgccggaaaacagcagatatccgctgttggcttatagctggcatcattgttcagcctgcacgcagcgcgttctgggccagacgcggaggttgtcaatgctgtgatgtgttcagcatcgggtttgcttttgagcggtgcaagccctcagttattccgggctgattttcttttcaggtaatactccgctgccagataacccgttaccgcaacaaaggtgattcccccacccaggagtgtattgttggtcggtaattcactgaagaatatccagacccacaaaggccccaggaggatatctgtttgtgcaatcaggctggcctccgcggggttaacatatcggcttcctgccatgaacagcagatagctcatactttgcgtcgccagcgcaaaagcgaacaaccataagatgtcatgcaaaccgggaaggggaaggtcttgtggcatcatcgcaaaacagaagacaccacagagggcacatgcgagagccgtaacagccggcaggttcatctctggccactttcctgacatcactatgctggcggcaaacccggccgtcatcaccagagccagtgtgttacccgccatatcgcctttccctgaggcagaggctgccataacaatcacccctgtgaggctcactgctgcggaaataagcgcacgttttgtaatttccttcttctgtatcagccagcccagccccagcgcaaaaaagggaattgttgcataaacggtcatcacgcctgcgacgctggtgagtttcagcgctgcgacatagcaaaacatggaaatcgccataacagtggcggttatcaggccttttaagcccacatcatgacggaatgaaaagcggcgcagatagccgctccccatgagcagaagaaccagcgacagaaaagcaaacagcgagcgccatgcaaccatcgcccacgtgttcatatcgagcatcctcacgaagaagcctgcggagctccacatgatggccgaaagaaacaccataatcagtcccaacgtgtgtctgctggcggtctttatcggtggcatcgtttatccttatcccttatagtctgacaaaataagtagaacggtctaattattatggcaaagaatgatacgcgcaaacgtcttttgagtgccggtatacgggttttcatgagagaagggtacgaagggggagggataacaacgattctgagtgaggcaggtatgcctaaaggatcgttttataatctctttccgagtaaggaagagtttgcctgcgccgcacttgacgcttatatcgagacgtttgacgcactccgggcagagacgttactgaaccgctccctgcatccccgcctgcgtctcatcagctggctaaacgggcacagcctgtatattgagcgtgaacctgaagtcgcgggctgtctggcagggattattggacagacgggggccgtacacagtgaaaagattcggcaaaagctgcgggcaatttttgcctgttgggagcgcgatctgattaccgtgtttaatgatgcccagacgctttcgccagggatgacgccggaaagcgcggcaaagctggttattcacagttacgaagggattatgatacgtattcgcatagaggggagcacttgtccttatgattttttgacacaagtgctaccaggcattcttttttcagagcccgacgccggtgccgacctgaccgccgaccctccgcgctaaaagagcagcaatctgctgttaatatcatcaccgcaatgggttcatcgcggatacagattctcagatgttcgcctggtgccagaagcggaggcagcttacatcgtgctatggtggtttatgtggagaagttcagcgaaagcaatgccttcaggtaaaaggagtgtcagatgaatttagaaactgcgcgtttaaggcttgaaccctatgatgactcacactacgaaggcttaagggtaatggaaaacgatgccagcgtgatgcggtatatcagcaaaggtattgttaaaacaccagaagagacgtgggaaaatatcaggcgagttcaggcccgatggcagaaatatggattttcgtggtgggctatcaaagagaaggcgtccggtgccattgttggagcagcatgcctccagtacctggcaaacgttgaaggtgcacccttagagattggctggcggcttgtcccggaacacaatggcaaaggctatgcaacagaagcggctaaagcgattattgatttcgcagcagagcagatgggcgcaacatatttagtggctgttgctgaccctgaaaatgcgccctctcagcgagtgatgcagcgattaggcatgacgtacaaagcaacagaacagcattatgatgtgccctgcgtcgtttatgaacttagcattcagcgcgatccgtcgtaatggggatgtgaacatcatgtccgctttgtgccagaagcggacatgattagcaatttaatcgttcaagcccgtccgcctgatttaacagccttgacactgacgctgacattcagtcttttcgcttccatagttatcattttttgagcaagagccatgtccccaccatgcacccggtctatcaatgtttgtacgattgtcatcattagaaatagctgattggcaggataaaaatctgccatatttataccgtgatctgatagttgctggtgcgcggctttctctgttttttcaactatgttagccacttcctcagtcattttatctatatggttgaagacaacacgattgataatgtcaatttgttcaggagtgaaggtcttttccatccggactcacctttcaatgctgtaagtatcctagaggatatcatatcttgaccagacgcgactgaatgaccggatgcgtgattttgccttgtctttactggtcagggttaacggcctttttcgcaaagattagtaagggataattatttaagttcagcactatgtccgattttcgctcatagcggaccttcagctcagtcagcctgtccgctttgtgccaggagcggacattgcattgatcagtttattttcaaaatatcatccaaacctcagtgcgacgaaacaaatgtcgatgtttgctgcaaagagggaaacgcgaagttacgctgcatacgttttacttcctctgccggcggcaggccaaacagccgtttaaactcacgattaaactgcggtgggctttcgtagccaacagcgtagcttgcggcagcagcagtaagcttcttgcggaccatcagcattcgcgcctggtgcaggcggaccgattttacatactgcatcggaggcatgctggttatcgctttaaaatggtgatgaaatgtcggcacgctcatgccggtttccttcgccagttcggtgagcgttacaggctcagcatatgtggcatgaatgcgccgtaacgctttcccaattttgccgaactgcccctgcaaggccagcgccgcgcgcattgcattgccctgcgcgccggttaacacacggaaatagagttcacgcatcctcgctggccccagaattgcagcttcagtcggattgtccagaacctcaagcacgcgccataccgctgtttttatcgtgtcatccatcgggcttgatatcatgctctcaggcgcggcggaagggggcagagcgccatactgttcgatctgtagcatcagttcagcggccagttgaaaatcaagatgaatatagacggccagcaacggatgctctgctgatgcgtcagtctccattgtaaaaggcacgggcactgagacggcaaggtagtgctgttcatcatacaaataggtctttttgccgaagtaaccgcgtttactgccctgaaagacaaaaacaattccgggatcatacagcactggcgttcttgcaagcggtcggttggcgcgcaaaattctcacgtcgggcaatgcagtaaggttatatccctcctgaattgccagtgttttcacccgtgtaatcatgtcggacattatagagcctcataaaatcaggcaataaaaccataagatttggcctgaaaatccatcagtacagacaatatcatgcagcttttactgcatgggaattaattatgacatctgcaaaaacgatttttatcactggtgtgagtagcggcttcggtcttgccctggcgaaggaagctctgcttgcgggccatcgggttatcggcactttacgcaactgtgaatccattgatgcttttgaagcgcttgatgcgcagcgggcattcggccgtctgcttgacgtgactgacactgaacgtgtcgatgaggtggtcagagaaatactggaaactgtcggtcctgttgatgttctggtcaacaatgccggttacggccatgaaggtattttggaagaatcctctcttgaagacatgcgtcgccagtttgacgtgaatgtgtttggcgcagtagcgatgacaaaagcagtactgccggtcatgcgagagcgacgcagcgggcacatcatcaatatcacgtcgatgggcggtttcatcaccctgcccggtatcagctattactgcggcagcaaatttgcgctggaaggcatatcagaaaccttaagcaaggaactggccgcgtttaacgtaaaagtcaccgctgtcgcacccggctcgtttcgcaccgactgggcaggtcgctcaatgtcacgcagtgctcgaaccatcacagactatgacgcgttctttgaccccattcgcaaggcgcgtcaggaaaaaagcggaaatcaacccggtgatcccgtaaaagcggcgcaggccatcctgacattgattgaaagtcagaacccacccacacacctgttgttaggcagtgatgctctgagtctggtgcggcaaaagctcactgatttttctagggaaatagaaaaatgggaaaaattaacgctttcgactgatggctaacccgtctctgaccgcgggaattgactggacaatctggtatggccgctcagacagtcggccattttacttaaggatgatgctagtacttatgtatggtccgcttttcgctcatagcggacctccagctcagtcagcatgtccgctttgtgccagaagcggacatgactaacaacacgttattttcatcaattaattgcagccaattcactatcaatgtttatgtatcagcctggtcagcatctcgcagaaggcctcgcttgctggattaacgcggtgtttattcaggcgtagcaggcaatcaaccgacggcagaggcatccatgtctcaagttcatgcgcattacaaattgttttctcaacgctgtattgattgagaattcctacccccagacccgaggttatcgccgcaagcataccagccactgaaggacactccagcatcacagtaaatggaatttttgcctgccgaagtttctcctcagccaggtttcggtaatagcaatccggtccccaggtaataagcttcaggcgcttatccgattcatgccgccaggcaggcgttgcgtaccagtttaatttttcactccacaataccttatcttccgtcgatgccgtgcccgtgaaatcctgatgtaaaatgatctccagaccgccttcagcaaaatgctgacgcaggagatgactttgctccaccaccagttgtatatccacctctgggtggtgatgagtgaaggttgaaatcacctcgcatatttcagtcattgagatgtgttcagtaacccctattcgcagcttgccacgtagcgacgaaggcgaaaaataggccacggcgagatcgtgttcagtgagtattttttccgcatgttgcagcagaacgctgcccttttctgtcgcaacggcttttccggcgatgcgcgtaagtagctggcatttaagttgatcctcaagccgtctgagcttccagcttacagcggactggctcaggttgagaagtaatgcggccttactcatgttgcccgtttgcagcacggtccggaacactctgagtgagtcaacggagagtcgtttattcatttttatatgacaaaagtgggtttacagcgggaaagaatgtcactggtgtcatatgcagtcaacggatagcctgactgaaacaaacacaacggaaaaagctgatgtccgctaataacgcattaatgaatgaccacgttctgatccagggttgtcgcattgcgaccggggtccatggttcaggaacacctctggtgctggttcatggcacgcccgcacactcagtgatctggcagtcactggtgccggtatttgtcgatgcgggttttcatgttcatctgtatgacctgcctgggtttggcgcatcagagcgccctttgacggctgatacctcggttgccgctcaagtcggttttctgctgaaactgcttgaacactggcagctcaaagaaacacatctttttggacacgatatcggcggggccatttcactcagactggcgttcgataacccatcccttttgaagacgcttacgattgccgatattcccagctacgactcctggccttcacccacatggaaagatatgcgggataactatgcggattatgcgctgatccccgccactgagcattaccgcgcgatgtctcgccagttaaagatggctgttttcaataagcatctgatgacagagcagcggctggaaagttatctcgcaccgctttgtggtgtggtagggcaaccttcgttttaccagcatcaggttgcgcactataatgcctgttacaccagtgactttgcagaaaaattgccgcaactccggctgcctgtgcaggttttatggggcgccgaagatgaatggcaacccgttgagtatggaaggcgtttgcagcgcgacatcgtctcttcctcgcttcatatctatgaacaggccggacactttttaatggaagatgctcccttgcctgtcgccgcacagttaattgattttgttaatcaacataatatgaggtagagccatgatcctgatcggaatgctggattcaccctatgtcagacgggttgctatttacatgaaagtattgggtattcaattcgagcatcgaccgctttcggtattcggcgattttgatgtcttaacgaaaattaatccggctgtcaaagttccaacgcttatcacagatgataatcaggtgctgatcgactccacactaatcattcattaccttgagagatattgcggtcattcgcctgcacccacagcaaagtccggagtggaagaactccgggatctgcatcttaccggcttcgccctggcagcctgcgaaaaagcggtgcagattgtgtacgaacagcgtctcaggccggaagaaaaacagtatcagccctggttgaatcgggtaactcaacaacttcatggtgcatggcagacgctggagaacgagctgcgagaaagtcatcctgacatactgtccgtggccggtatcagcatcgcagtggcctggagttttacagaattgatgttgccagataccctcagccgtgagctgtatccggaagtaaccgggtttacattgctggccgaacagcgcccggaatttttggcaacacctttgagttaaagagtgcgggtggcgtctcattgatgcagtatctgtataagggaaacacttactgcattaaaatcaatccgttgtaaaaggctactctgtagacgccagttaaatatctatagaaaagacgcacaacccttaataactgaatcgccatggcttctatagacctgtaaaaggacattatcgtggctatacgcagggaacagttatctttcgcttctcgctcaaagcgaaccgttccccttctaaagtccgcctcgtgctgcgagttcaacgggtcgatgcaacgctatccttaatcaagcgggacgttgctgcttactcgaaagaatatttttatgaagccgtagttccggtttatttagcagaatttatttaattgattattgatacatagtggtgttctgagtaggacgttatataagtcaatgtccgtttctcatataaagcggacattatctcaataatcagattttttaagtttttacagaggcagaatgtctgtccatgcaaatgatccataccaggccgccaagaagtgagaaagcgataccgatataaatagctgtatctggattctctgcgagggtttttatatcaccaaggagaccaccaaagatggcgacgcccagcgcagaaccagcttgccggctggcattgagtacaccggcagcaagtcccgattgttctttgacaacagcattcatgaccgctgctgtagcgactggcgtaatgatgccggcagcaaggctgagaagcggaaagcaaagcgcgatctgccagtagtatgcattttcatttagtatcatgagtcctgcgaatcctgcagcgtagagcccataacatccggctatcagcctaaaagggccgaacaggctattgagctttccggcactaaagctgcctaatgtaaccatcagggttagtggaagaaaagcaagacctacatttagtgatggccagacttttccagcgtcagaggtgaaagtcattgcagaagttaagcatgtggtttcagctgggtgtggcgcgttacgctttcaggaagggaggcggccctggtgaaatgaacaggcctatatttgcctggaattcaaagagcgtaaactaagagcaaattgttgcatcgccagtaaaagaagcttttaaggtccagattctgcaattcactaaatacctgtcatttacgcgttgtcatcatagatgagcataaaataagctataagatctgtttttaacgctgacaggaaatacggatgaagaaaatttttgtgctgctgtttggactgaccatcatgatcccattgagtgccgacgcggacagcacgtatgttttcttccgtcatggggagaaacccgataacaccagtgggcaactgacctgcaaaggactgaaccgcgccctgaagcttcctgctgtgttgcttagccgctatggaaacccggatgcgctttatgcttctgcacctaaagaggataaaacaggaagttcactgcgcccactttccaccattattcccctggcggtccagatttcgaagcctgtgatacttcgttttcacgctgacaaaccgggtaaactggtctctgacctgctttcagaaaaacaggttccgctgacatttatcgcctgggaacataaaaatttggtcacggcagcccgaacgctggttgaaaaaacgggaggtgatgccgggcagatccctgactggccctcggcagattttgattcactgtatgttgtgaaaattgacgaccagcagcatttcaaatcgttttctcacgagactgaggggctgaatggcgtctcaacggaatgccctgacagcgctcatcattgactgacttagcggctctgcatgtaaggtaaatgcagagccagcgcccagggttgggcgcgcagctgagtcaaatgaatcgactcgcgtcacgctgaaaaggcggaaagcgtccagcctgatggctgagcattctactgcgcagcagcaggttacaagctcctcttttcaaaatgaggtgcgggcgtgatctttttcggttatttcacgcacgacgcggcaaggattacccacagccagaacgcctgacggaatatccttgaccactacgcttcccgccccgatgacaacgttgttacctattgttatgcccggaataatgctgacacccgcaccaatccagacattattgccgatggtcacagggctcgcgtattccagtccctgatttcggcgttcggcatccagaggatggcctgcggtataaataccgacgttgggtgcgagaaagacgttatcaccgatcaccacgtcagccccatcaagaataataagattatggttagcgtaaaaattgtcgccaatcgtaatgttaacgccatagtcgcagtaaaaagggggttcgataacgggattgctgccacactttttaagcagccgggtgagcagcgcaaggcgtgtttcattattatcaggccgactcaggttatagtcataacaaagcatcttagcgagcccccggcgttgaagaatgcgttcatcatggtttgcatcatacaaagtaccatctggtactcgggtcacctcgttcatcttcttccttatcctttcggcttaaatgtctttatctcaggcaccgtgttcaggtgctatccagcttagcgcgtttctgtcacccctgcggccctgacagtcccggatgcgtctgtggcatgttcgcgcctttaaacatgtatcgcacacgatttaatcatattaagaaacagcaggggaacgacgccatgccgacccgctaccagacgcaggcaccgccgttatccaacgtcacgctggttgaggtttcagcgcccgaaacccgtcacagcaaaatgtaagcaaagcgtagatgtgcttttttgcataaattttgccaacgccgttttttactatggctcctcatttcccggtcatgacagcgaggcgtggttttatgaagcagttaagaatttatacactgaaggataaagcgagcgctgtggagtatttcagacagtgctggccaaaacacagggtcagtttgctgaaatttggcatagaggtggacaatgtgtttctggggggaaatgaccagcaaaatcaggtgatggctgtggtcaccttaccggagggatgtcatgttcaacatctgaatgagcaatatatgcgtagccaggcattccgcgacgatatggccgggtttcctgtggcgaatattattcgggtcgaggaaatatgtattagcgaaacgcttttttaatgatgttttctccttcgctcagggctgggatgacacgcaggcgcgatttttcaacggacgcgtaagacgtgcaacttcgttaagatgacgcacggtgaacagaataaaatgtgcatgtcagcaatggctttctctgcttttcatggcatcgggtaaaaaaatacccgatgccatctatccgaaacctcgcgctgtttaatcctgtaaacctgacgtgcagaacttacgtgtgaagaccgcgttcaacaccggggcgcactatctgctgtggctgtccgcggtgccataaacccgcttgatgcgatgacgagagaaaaccctgtcctgtcgcgacagacagcccgcgaataaaccgcgctgaccaccgcacacctgatttatccctcccgactacccataccgttgttcattccctggcccgcgcatgtgttctcgtctgccgttcacgctgcgaggcagtcagaggctgcgtcacttgatgtgaatgccacgttaaaggacatcccggcagtgtcgtgatggttttgctgttccatttaacaaaaaaggaaaattacccgaataataaataacttataattaacagcctgcgaaagatcggcaaatgcgaatttgtgatccttatgttgatgactcactggattttgccagccactttattttcccggcagccattcaaaggctgagagaaagcagctccctctagactgctgctaatcgggaaacatcggtttcctgtttggcctcaacctgaaaaaggaataacaatgaacagcgccattattgcaggtattttctggcatctggtgggggccgccagtgccgcctgtttttatgctccgtttaagcaggtgaaaaagtggtcatgggaaaccatgtggtcggtgggcggtgtgatgtcgtggctgatcttgccatgggcggtcagtgcggtactgctgccaaacttctgggcttattacaccagcttcagcgcctcgcagttgctgccggtgtttctgttcggtgctatgtggggcgtgggcaatattaactatgggctcaccatgcgctatctgggcatgtcgatgggcatcgggatcgcgattggtattacgcttgtcgtcggcacattgatgacgccgctgctgcagggccggttcgtcgagctgttcaactcgcccggcggccgcatgacgctgctgggtgtgctggtggcattggtgggcgtggccatcgtctcgcgtgcggggttactgaaagagcgggcgctagggattaacgcggaagagttcaacctgaagaaaggcctggtgctggccgtcatctgcggtattttttcagccgggatgtcgttcgcaatggatgcggcgaaacccatgcatgaggcggccgccagcctgggcattaatcctctttacgtggcgttacccagctatgtggtcatcatgggcggcggggcggtgattaacctggcgtactgttttatgcgcctggcgctgaagccagagctgtcagtgcggcaggacttttccatcgcgaaaccgctactgttcgccaatatcgccttcgccattctgggtggaaccatgtggtatttgcagtttttcttctatgcctggggacacgccaaaatcccgccgcagtatgactttgtcagctggatgctgcacatgagtctgtatgtgctgtgtggcggcgtggtagggctggtgctgaaagagtggaaggacgtgggacgccgtccggttcgggtgttatcgattggctgtgtggttatcattatcgcggccaacatcgtcgggcttggcatggcttcctgaaacaaaagaaatcaggcctgacgctgacgtcaggctttttcattatcggtgcgcaggcgttgtggcagaaagcgctgccgccaggcactgggtgtcaggccggtttctcgcgtaaataccacagaaaaatagttactgtcgtcaaacccacactgcgccgcaatctcgctgattaaaccggactgggtgcgcaataaatgtttggcctgacacagctgtaactgacgtaaatagtggccaattgtcatgccggtttgctggcggaacagctgcttaagcgagcgttcactcagctgatgctgctcgcaaaagtctgccagattcaaggggcgactgatgtccactaacagtgccgacatcagccgatccagttgctcgccttcaggcagggagccggcacgttcgggagcataaccatggcgacgtaaaatcagcgccagctgcaaaaaaagcgcctcggacagttgcacggagagcgcatcacttttgcggctctcgcgctccagctggctaatgacgccccgtgccagcgtcataccacgagtcgtgagccgccagccactgggcatggtttcttgttggggcggtaacagctggccccagtcaagcgcaagatgaaaacggtcccggcaatacagaatgttatcaagggccagatcgtgcacgctgtcatagctatggcagtcgctgtcgcaaatataaaaaacatcgccgcaggtaatcagccacgggcgatcgttaaggatatgcaggccattgccgcgccagacgataacgatctcgctgaaagtatgctgatgcggcggaaaggagggctgtggcatacgttcagccacagcaatgggcaagttgctggccgggaagtagtccttacgtgacaggatcagtgacatagttaatgctccgcttaccacataggctggcgctccgttcggggcgcgcagccaaattcccgtctgaacagggtagaaaaatggttactgtcaccgaatccacactgataggcgatgtccgttatgcgcatatcgctgtgacgcagcaggtggcgagcctgcaataaacgcagccggttaagatatcgctgtggcgtgctaccggtttgctgcttcatctggcgatgcagtgtacgcagtgacagcgagaagcgatcggccagtgcttcccagctaatctcctcactgtagtgatcattcaaccagtctagcaaccggtgcagcctggcttcctgatcctgcgcgttggggttgtgcgccgcttcacgcagcagtacgagtaactgtaaaaactgcctttcctgatgcgcctgacgctccagcgaccacaccgcctgcggcgtcatctgttccaccaggagcagggcctgcgccatcgctttttgattaatccgccagtgagacgcgcacccacggtcatcctccaggggcagcaacgcctgtaagcccgatagaaaacgaaacgccaccggactgcgatacagcacgttcgtcaggcacaggttgtcggttttctcatacagatgacgatcgtgatcgcgcacaaagcagacgcaaccggcgcttaatgtctgcgcctgaccattgaacacatgaatgcctgaaccctgttcgaccagcacaatttcgtgaaaatcatggtgatgttcaggaaacgcctgctggggcacacgcggctcaatggcaatggcgtaatcgccagccggaaagaaatcagcactatgcagaacagtcatgattcgccctcgtttaacaaaactgcaaccgagtctacgcaggcgatgtgcagcttaccttgaattttgaaccgtgcagcgcaggaaatgcgtgaaattttcaagatcgcttaagtgattgataaaaatgcgggaaagctcacaactctgccgttaaggagttctgtgagcttcctcacgaacacctttgtcaccctgccagtgccgctaaccgtctggcagtgccgctaaggtgacagcagggtgcgctgcgtatcctgtcgccatgtcatttcaggaagaacaggcgatgagcatgcgtaatagtgtggcgattgatttaggcgcatcgagcgggcgcgtgatgcttgcacagtggacggccgccagccagcagatcaggctgcgcgaagtgcgccgctttaccaatcaacgcgtttgccaggccggctatgactgctgggatctggacaggctggagcacgagatccgggctggactggcgcaactggatgaagagggcattgtgcccgacagcatcggcattgatacctggggcgtggatctggtgttactggatgccgaaggagcacgcgtcggtgaggcggtgagctaccgggacccgcgcaccgaaggcctgatgaaacaagccatcgaggaccttgggcagcaggccatttatcaacgtaccggtattcagttcctgccttttaataccttatatcagctgcgtgctctgcatctgcaacagccggactggcaggcgcgggtcaaacatgcgctgatgatcccggactatctgcattatcgcctgacgggcgtgatgaactgggaatacaccaatgccaccacgacgcagttgctgaacatccacagcggtgagtgggattctgacctgttggcctgggcgggcgtcgatcccgcgtggttcggtaaaccgcagcctccgggcaacagggtcggtcactttatcagtgcgagcggcaaaccgattccggtcatcgccgtggccacccacgatacggccagcgccgttctggcgacgccgctcctggcggacaacaccgcctacctcagttcgggtacctggtcgctgatggggattgaaagcctgcaaccctgtgtgagtgacgcggcgatgaatgccaacgtcaccaatgaaggcggcgcggaaggctaccggatactgaaaaacattatgggattatggctgctgcagcgtgtctgctcggaacgcggcatccacgatttgtgcgcgttgattgacgccgccgcccgtcaaccagcctgccaggcgttgatcaatcccaacgatgcccgattcatcaatcctgaaaatatggtgcacgccattcaacatgcctgtgcagaacaggcaatgccggttccgcataccgacgccgcactggcccgcacgatttttgacagcctggcgctgctctaccgccagacgatggaggagctcagccagttgcgcggcacgccattgcgccagttgcatgttgtcggcggcggcagccagaacccgctgctgaaccagctgtgcgccgatgcctgccagttgccggtgctggcggggccggttgaggcctccacgctcggcaatgtcggctgccagctgattgcactgggagaactgcgcgatgtcgctgaactccgccgctgcatcagccgcaatttcccgttagaaacttttactccgcagaatcacagcgcctttgcagcccatcaggctcgcttcgccgcgctgtgccaacccgctaaggaatgtgcttatgacaaagctgattgaacaggcttttgagctggctaaacaccgttacgctgccattggcgtcgatgtcgaccaggtaatgacgcaactggatgagatcccggtctccatgcactgctggcaaggcgacgacgtgcgtggatttgaaaatcccaacggccagctgacgggcggtatccaggcaactggcaattatcccggccgggcgcgcaatgcggttgagctgcgtgccgatctggataaagccatgtcgttaattcccggcccgaaaagagtcaatctgcatgctatctacctggaaagtgatcagccggttgagcgcgatgcaattgaaccgcagcatttccgtcactgggtcgaatgggcaaagcaaaacaacctcgggctggattttaacccgacctgtttttcccatgcgcacagtgcggagggtttcacgctggcgcacgccgatgcgggcatccgtcagttctggatcgatcactgcaaagccagccgccgcatttcggcttactttggtgagcagcttggcacgccttccgttatgaatatttgggtaccggatgggatgaaagatctcacggtcgatcgtgcggcaccgcgccagcgtctggccagctcactggatgcgattatcagcgaaaaatacaacccgcaacaccatatcgatgcggttgaaagcaagctgtttggcatcggcgcagagagttatacggttggctccaacgaattctgcctgggcttcgccgccagtcgccagattgcgctgacactggatgcgggccattttcatcccaccgaagtgatctccgacaaaatctcgacagcgatgctgtttgtcccgcggctactgctgcacgtcagccgtccggtgcgctgggacagcgatcatgtggtcctgttggatgatgaaacccaggccattgcccatgaaatcgcacgccagaagctgttcgataaagtgcatatcggtctcgacttttttgacgcctcaatcaaccgcattgccgcctgggtgattggcacacgcaataccaaaaaagccttgctgcgtgccctgctggaaccgagcgatcagctcagagcgctggaacgtgaaggggattacaccgcgcgtctggcactgctcgaagagcaaaaatctctgccgtggcaggcggtctgggaagcctggtgcctgcgccatgatgtgccagctgatgccagctggctgagcgaggttcgtcactatgaacaccacacattgcgtcaacgctaaggaaaaggctatgcaaactattttgaacgctgagtttgtgcaggggatggtgaaagtcaccagtgatatgtggctgaaaggctgggatgagcgtaatggcggcaatgtcagcctgcgcctgttaccggaagaggtagccccttttgccgccgatttttacgcgcagccgcgctgtgttgagttaagtcagcctgtcccggacctggccaacgactggtttctggtcacgggctcgggcaagttctttcgcaacgttcagcttgatgccgcggacagcctggtcctgttgcaggtggatgacaaaggcttgtcgtatcgcatccattgggggctgagtaacggtggaatgccgacatcagaactggcgtcccatttccagtcgcacgctgtacgcaaacgcgttacgcaaggggccgacagggtgattatgcactgccatgccacaaactttatggcgctgagctatgtcgtcaacctcgacgccgcgcgcttcactcgcctgctgtgggaaggcagtaccgaatgtctggtggtgtttccggatggcgtcggggttctgccctggatggtgcccggcacggatgacatcggtcaggcgaccgctgacgaaatggccactcacagcctggtcatgtggccgttccacgggatctttggcgcagggccgacgctggatgacaccttcggcctgatcgataccgcggagaagtcgtctgaggtggtcgtgaaagccctgtcgatgggcggcatacgtcagagcatcacgacggcgcagttaatcgcgctgggtgaacgctttaatgtcaagccctggccggcggcgcttcaggcggtgcgcagtgatgttgcgtaaggcgtttgtgatgcaggtgcatccggactgccacgatgagtatctgcgccgtcattcgcccatctggcctgagctggaacagacgcttaaagcgcacggtgcgcatcactatgccatctggctggatacgacgcgccacctgctttttgccagcgtggagatcgaatcagaggcgcgctggcaggcggtggcgcagacggcggtgtgccagcgctggtgggcatccatgcaggatgtgatggtgacgaatgcggataacagcccggtcagcgaaccattacagcccatgttctatctgccttaggccgttatcgggcgacagggccggatgaaaagggcctgtcctgtgcagggttgcggcggtggtgctctggcgtcaccgccgacctgcgtaatggcgctgcggagggcgacaacctcagtagcgaacccggctgctgcccaggcgcaagttgggcacggctgacatgaccgggccagggatcactggcatgccgttcagcatcgacaaaaatgcctgtgcccagtgatggctgtcatgcagatgcaagcccttcatcaggcgcgcatgcagatgtcgccgttcacgcaatggcatctgcagggcgctgtgaatggcatcggccatggcatccggatcataaggattgacgataagcgcaccgtccatttgctctgccgcgccagcaaactgcgacagaatcagcacgcctgggttatccgggtcctgcaacgccacatacatttttgccattaaactcattcccgacatcagcggcgtgaccagcgctacgcgtgaggcgcgataaatgcccgcctgttcctcacggctgtaggcatgagtcagacagttaacgggataccagttcatcatgccgtgtacgccgttaaattcgccgcaaagggtttctaacgtgtgcgcgatgcccggtgcccggtccgcgtagcccgcagcgtgcggtgccagctgtagcagggtaatatttttttgatagaccgcatgtttgcgcagcagcacttctatcgcgctgatgcggtaaggcagtccggcgctttcatcaagatggccgccgctcagtacggtgttttccgctaagctttcacggcactgcatttccataaaggcacagctgttgctgtcacgcagacagcgcacatcatcaagatcaatcccgacaggaaagacgccgagcttcacaatccgtccctgcacgcgaatgctgtcaacgctcaggcgctcggtacgacattcgctctccagccagacgataaagttgttcatgtcctgaacggtctgaaagccaatcaggtcacagcacagcagcgattctgtgagccagcgccagtcgggaatcgcctcaaacatcttgcccgagggaaaaggttgatgcaggaaaaagcccaccgggttggtcagtccggcctctcgcagatagtgggcgcagcctaacaggtggtaatcctgtatccagatggcgtcgtcgggcatggcgttatcacagatgacctgtgcgtaggcttcgttaatttttttatattcccgatagccgtcagcagagaagcgggccaggtccggacgctggtggaaaaccggccacatccctttatgaacatactggtgataaccttcattcacctcgtccctggacagaggaaaggtcagggttgcataagcgtctttctgctcagcgctcagcggcctcggcgcatcaggaggcagaaccgccgtctcgccatcccaactgatccagagtccgccgttgcgggaaagaagaccttcataaatggcggacagggtggaacgttgtgaatgattgtgtgataccaggataaaacctgacatggtgttttccttatgggcgggcagggcgtcagtcgccgtgcccgatgtccaacagtcgtcgtgtggaggtcggatgagaaactgcagcaggccgcacatagcaaggcgtcctgttcgtttaatggtgttgggtgcggtcagcacgcaccgaatcacccaggccatcaggtgaaaccgtcctgagataaatgcccggcagcgcgtcatgacaaataaacccgttacgttccagaaaagccggcgcgctgtcactcagggcaataatgcgctggcagccaccggtaccaggatgcgtcagacagcagtgcagcagccaggagcccagtccgacatagcgatattccggcgagataaacaggtcctgtattatccaggtttcggccatgtcggtgaccacgcgcgcaaagccaatctggcggtcatggcgataaagcccaaaacagagactgctgttcagtgccagcgtcagaaaacgcgcatcagggatcaccgcacccagccactgggcaatcagccgcgggttgagcatggccggatcggtattaacctccatcgtctctctgaaccatttacggggagacatcaggcgaaggcgctgctgctcggcaagatccgccaccacggcatcaccacaaaccggcagcaaagaggacgcattcacgcatttcatcaacggcttccttgtacatggacgcatctgcgcccggtgctgtagatttaagcgcccggcgtgtaaaagtggcgtaaaaaaaatctgatgcggtgtaaaaagggtgcaaaggaaaagcgacgaggtgggcgcgccgagcccgttatccgacgtaaggctggacaaatatgggttatcgagagattcgcccccgcagaacaggcgttgttttcttaatgccgggcacagcttaaggctacggccagaagacagagaagaattgttcgctcgtaagccagattgttaacccctggatggcttactgaatttcaactttgtctttactggcgtcgcactattccgatcgccgctttaacggctaacggatgcgtaacccactggcaggcgggttacgcatccgtcaccctccgcctacaggggtgaattcacggcggtatcgttagtttttttcgccggtgtgacgccccagacttcgtcatattcatacccggtcagcgatttgatcactttgcgcgtttctgcatcgcagtctttgggtgcgccgccaagcttacgacgtgcgacttctttgatcagcaacctgtgactgctctgggtcagcttgaacttataggtcagccagaaactgatggtcagtagtgtgccagacacaaacaccaccaataccacaatggcattaatcgcactctcgggttgggcgccatttcctttcgtaaaaccgctttcctgcaggacgaccccaatcataaagatggcaatggcgacggagcttttacgggttaacaccattacgccagcaaagattccctcccgacgcttgcaggtgaccatctcatcaatatcaggaataaaactgtagatgttccagggaatgtagaacaacccggcacgggcgatgcccataaaaagaaatattgcgctgaacagaagggccggtacctgccagtgccagagataaacggcaaacagaaagaataagatcaccagaatactgagataggaaattctcagtgcggttgagggcgtcatatttaaccggcctaacagcatcataaatacaaacgtacccgggatagacataaacatcatgttgctcagtaacagagaggccagtgaggcgtcctgtttcagaccgtaaatcacgaagtaggtaaaaacggccaggaagacatccatcgcggtaaatgagcagatataaatcatcagatgctggcgaaaggctctgattttgaatgatgaaataaggtccacaaacaaatatttaaaatgcgccaggaaatgacctttcctgaccgggtggatctcatcaggctgcccggtctgtatatctttcgcttcccaggtggttagccaggtaatgaagacggcaacacaataaatgaccgaaaaaatgatccccgtcagcgtataagtgatggcgttatctttgccagtgtaggtcatgatcagccccggcacggagacagccagaaaactcccgagcgaagagaacatcaggcgcacgccggacagacgcgtacgctcgctgaagcggttggtcatctctgatgacagggtttcccacgggaccagcaccattgcagagagtaattcaatagtgaggtacgtaccgagataataccagtagctcatgtccgtcacccacagtgcgccatacagcagcatcaacggtgacgacattaataaaaagaagcggcggcggccaaatttacgccccgcccatgtattgccgaaattatcggtgatgtaacccattatcgggcttaaaacagaatcgatgacgcgggcaatggcaaatatagaccccgcttcaaataccgataatccgcaataagtggtgtaaaaaaataacagccaggcaccgataacggcaaaagcgcctccgccaaataaatccgttaagccgtagccgattgctacgccataacctacgcgacgctgagtgggtttaaccatcgataaaattcctgttctggtaggtgttttataacggcagaggtgcgcgatgctgccgtctctgttatagacagaagtggaaataaagtcggtcagcggtaggttatcccgcgttagctaacatctgtgctttaatgcatagttcggcggctttaaacgcatgctcttgcgtcatagcctgttcagtacgatgcagacagtcattaattaactggccgaaaaacggaaaccccacggtgccagaaacgctgtaacgaaattcgccgtcattattgaccaggtacactacgtcctgctcatcgcgcgtcagatcggtgtatttgcggatttcgatgtatccttcggtgccaagtaacgtcatgcgtccgtcaccccacgttgataagccatcaggtgtaaaccagtcacagcgaaaataacccgttgcgccgttttcgcccgccagcattgcctcaccaaaatcttcaaactgcgggtggcgaggatgactgaaattgcggacctgactggcgaccaccgtggcatcgcggttgccggtgtaatagaggaactgctctatctgatggctgccgatatcacacaggatgccgccaaaataacgacgctgatagaaccagtctggtcgacccgtgccttcccgatgtggacccgtacccagtgtctgtacgacctggccaattgcgccttgttcaaccagttgcccggcgaataccgcactttccacgtgcagacgctcactgtaataaaccgcatatttacggccggttttagcacatgtcgctctggcatcttccaactgttccagggtggtaagcggggccttgtcggtaaagtagtctttatccgcctccatcactttcagccccagcgcgcagcgctgtgacgggatcgccgccgctgccaccagttgcacctgccgatcggccaggatcgtatcgagtgaatcggcaatctgtacgtgcggaaactgctggacgaatttatcgaccttggccgcatccgcgtcataaacccacttcagggttgcaccggcctcggtaaggccattgcacatggcataaatatgtccatgatcgagcccggtggcggcaaagataaactcgcctggattgactacgtgctgcggcttgcctttcggcgcgtaattcatgccatcctttttattcatggttgtttcctcacgcaaaatttttacccaacgggatgtcgtcgacatcagcgaagttatccactgaagcctgcttttcgtagaaatggggcgcactggcaatcagtccgccggtacaatagaaggcgtcatcttcaggaataggtagcgagaccgtacttttggtgatggccgatttatagatggcggtaattaattccagcgaccgtttaccctgctcgccatcgattaatggcgcacactgttgctcaatggcgcagaaaaagtcattcacctgcccggcatgcagcgtccagttcagaggtggcacatcggcatataagcgctccagctcgctttccagagcaatattgttatctttttccggaaagccattctcagcggcctggttagctacggttttccacggcgcagagaggcgcgctttttcaccctgaagaatgattttttgatcttctccgtgatgcacaaccgaggccgttagctgcgcaagtgttccatttggaaagcggaaaatagcggcgctgagatcctcgacttcggtattgtcgtgggcaacgttgcccatcatggcaaccacttcactgggggcaccgagcatccactgcatggcatcgatatggtgcaccgcatgattaagcgtgcagccgccgccttctttctcccaggtgccacgccaccagaggtcgtaataagagtggccccgccaccataatgaatcgacctgtgcgtgacagattttccctgccagccccgaatcaacagcggcttttaagcgccagaaggcatcggtaaaacggttctgtgccaccacggaaaggacctttccgctggccttttgcgccgcaatcatggcatcgcactcttcgagtgatgccgccattggcttttcgcataacacatgttttcctgcctgcagcgccgcaatggtgttttctgcgtgcacatagggcggggtgcagacatcaacgacatcaatatctgcgccttctgccagcatctcatgatgatcgctgtaaacgcgcacatcctgcaggccataacgctgtaatttatcgcgggctttgtcaggataaacatcaacaacggcgacaattttgccgcgttcaggaaattgcaaaaatgcctgaatatgtaaattggcaatgttgcccatgcccactattgcaatctttagcatgcttattctccattggttcgctgggttgtggtgcctgcggaagaccataaaaaagcgctggagaggggacaaactgtttttgtgagaatgttcgcagagcgaggcggatgtttatgagcggaatgtaaaatcaccgtattatcaatccactatgactgcaaaaaattgcaaaaaatgattgagatggggatcacattatggctggcaagctccgaatggacgaaatttcagcagaaacgggctattccgtcagtacggtctcgcgtgtgctgagcggtaagtcttacaccagtgataaggcacgtgaggctatcgtcagttgtgcgcgtcgtcttggcgtattgcatgaaatggtaagcagccgcctgttgatcaacagccttattgtgtttgccccagcgcgcacctttacgccgcgtggcgatcatttttatctcgaagtaacgcgcggcatcgcagaagcctgtgcaacgcacgacgttcatatcagctactatccgcttgaggaacagcgtgccgatgtgaagctgtttcttgaaaaggcgggtgcaaaaagtaacgacgctatcatcatcatcgggactgacgaccaggcgatttttaatctggccgcgacactcaataagccctgcgtgttaattaattcccgagacaaagacatgaaactggatgcggtttcacccgatcaccatgcgattggttttggggctatgcagcatctgtttgaacagggccatcgtcgcgtgctgactgtgacctgtctgagtcgtgagacgctgtttctgcgcctggaaggcattaaagatgcttaccgccattttcatattccgtttagtccgcagaaagacctgattgtgatcgaagcctattcctctggtgagaccgaggacgcgcttaatcgctggctggatagtcatccacgtgaagcgtggccagatgttatcttgccggtaggtaaaggcattatcaccggggtacaaaatgtgttgcgtgcccgatcgttgcgtattcccgaggatatgtcgttgatgactaccgatctggcgagccggttagccgggccgccagacacatccatcactggctttgccgtgccctgtcgtgaactgggctacgaggcgattcagctactgcagaaccgcctgaatcgtccccaggcaccggtttataatctgctgttgcagggaatccttatggatggagggacggtcgccagagccacccgtcatgcggcgcgggatgagattcgtgatgaagagggttgaaaggggataaacaccattaattgtgcggtcaggtaaccgacgtgctcacgctgtatcattgtttttaacgtttttttcgatgagttttttaacgctcaatcttccagactcaggtcggcaaacatctctttgaagcggcgtttttttcctcaagagctttcatcttttcgatatcagaggctttcatatagccaaacttcgcttttcagttgtaatacgaatcctcagttatttccgcttcgcggcagacatccttaacggtacgtccggtttcgacggacttcagaacggcaatgatctggtgttcggtgagtcgggctttacgtatggcaatcaattccgagtacataacagtatgtcggaagcactctgaaatagaatggatcggtttacagggggaaggtcaaggcacaagcacaaaacaaacctacaagcggcaagtctaagacaccgatatccactcagattcgcctaaaagttactattaattatttttatgcccagcacccaaaagagtaacatatcatgcgtttagcatttttcacttttagcaagagcctgctgctttagtaggactctggcagctatgagcgaggataaaagataataattgcgatggccccaaagtaatcacatcagtatgtatgtatgtatgtatgtatgtatgtatgtatgtatgtatgtatgtatgtatgtatgtatgtatgtatgtatgtatgtatgtatgtatgtatgtatgtatgttgaatttaaccaaaaacatgcatagcttccaactgcttttttttcattccattacaagaggataaaaaattatctttaaaatctggtgggggagagtgtagtcgctgtactgcatctttatttccttctaactcccgtaactgtgcaattgtgcttctacgaatcgatgagagaaaaaaatccccagcattttatttatggctctttaaataattagttagtattttagacgatgcttgaattgctttttcctcagaaaaacccaaagtaaagtgagaattaatgacattgtattggtataggcatactgcttcagccatttgtttagcttgctcatttggggagggctgactagcccacgattgggaagtaatgagtaatataagcagtaacaatcgttttttcatgtgtagaatccataatatttgtaatgcaatatttaaacctttaaaacgtagctttgacaacaaccactaaagtgcttcccttaaatcaactgagactgtcgatctccacgttcgctcttggctcgtaacggacatgaacacagtgcaatttaagctgatagcaaccagctgggtaacttttaaagggagtttctgcgtttccattcattcaccacatcacctaaattttgggggatatcacttctaatttgcctgggaaaatgttgtggtgaaaagtttcaaacgctacaaagctcattagcacgtaatttccattcgtcaacctgagtggggtggtcaaaagagtaataaacgcaagcatcctcaggcagaatattacgcagtgcctgcatgcagttggcctcacagggccgcaattcaatataggcagccgtgattggtattacatcatcggtggaatagcgctcgatgcggtttatcgcggcaacgagagccgccatttcgccatgcagcctgacccaattatgggtatagattcctggtggcatgcttatctgcatccgactgtttccgaacgcataacgaatattaccccgtagcctgtactggactactgcacagcaggactcaggaccgaaaccaggctgtttcaccaaattctttttgtcctccagcgtgcgcctgacaatcggatacccggaactgagggagtattcagtttttataagttgcatcagagtttcctttacttgaacattcttaatcaatcatatggggttccggcgcaaacttccataagaacagggcacttaggggctggaaaaattaaggtccgcttaatacgcttcagggaatttaatattcatattagagccttgcgttttccttacggcttcaccaggcatataactgccgttccgcaactgtacggactctcgttcatatctgtggttcagtctgtcaagccagtgctttatggtctgggtcagtgagtattcagttcgtaagggaaaacctaatgatgattcaccgatctgagcaggggaatctcagcagccatcatgtctctgtctgacgatctatgtttatccgttaaatggtatttgcggcctaaatattcttaccggcgcaggccagtccggttcaatcttaagattcggtttgagctgtgagttcaatgggggcggtgcaacgcgatccttaatcaaagggggacgttgtgtaaacttttatccaacatatcagcccattcctgcatcatcactttacgttcatcaatataggccgcatggttgtaagtgcggcggacattgttggtgtcagcatgtgcaagttgggcctcgatagcatctgatcgataccccatcacgtttaaacgagtactgcctctggttctggtagcatgtgggctaaataccactccagccaatgcttttaagtagctgacgcagggagtgcgatgtcattggaccttggtgctgccatgcccggttaatccctgttgtgttcttagcattttacgacttgagaggaaagggagatatgaatcgcagacacctcagagtcatttaagatgacttaaagagaggtgcccatgatcggtaagcgttatcccgaagagtttaaaattgaagcagtcaaacaggtcgtcgatcgtggttattctgtttccagcgttgcaacacgtctcgatatcatcacctacagactttacgcctggataaagaagtacgttccggactcatccactaataaagaaccgtcagatgctcaggccgggatccgccgtctccagaaaaagctggagcggggttgtcgccggcaacggtaagcggcgggtctttctcatccgccattatcggagcacctgtggtgatgcctctgatatcaatattttctctttcgaagcagccgagcattttctgaaatacatgagcagttatcgtaactattcatgaaagtctcttgtccgctcctcgctcatatcgaagattaggatgacatcagtctgctttatgccacgagaggacatttaaacagcaatgccatcgttgcataataaaaaagatgacgaatagtttttttacgcaaggtaaatgctgattccacagccaaataaagggagtaagcatgggaaggtttcagggtaaacgtatattgatcacgggtgggacaagcggcatggggctggcaggcgctcagcgaattgtctctgaaggtgggcatgtagctattacggggcttaatgaagaaaggctggaacgcgcacgcagtatccttcctgtggcatcgcttgttctgaaaagcgatgctgcaagcgaaactgacataaatgtgctgcaggaagctattgatggctggagtaaacttgatggattatggcttaatgctggtttcgcggaactaagctctccgggatctgtaacagcagattcatttaatcgcatgatgaacgctaatgtgcgcggcccaatgctacagctggcagcgctctccaaatcacttaattcaggcgcatccgttctggtgacgcatcctcatctgtatatgaaggtgcggcgatgacaagcctgtatgcatcgacgaaaggcgctgttatcgctatggtcaaaagctgggcttctgctctggctgaacgcggtatacgcgccaacacgttggtgccaggtccgattgaaaccaacttcaggcactttttgccagaagagtcgcgtcagcagtttgaagattttgtggtaaaacaggttcctttgggccgctcaggaacagcagcagaggccgctgcagttgccctttttctcctgtccgatgacgcatcttatgttaccggcagccaatatgcggtagacggcggcctggtacattactgattgttatcagggttcataaaagcaactgaaattggtccagtaacgttcgcttttagcttgttggaagtgacgaagtacttgttcaagtgcacgccgccagccttaatccacttgaaaggcgaccaaacccaacattcccgctcatcctgggaactgatgtatccggagtcgttgcagcggccggcaataacgtctctctgttcagcccaggcgatgaggtctattcaatggtgcgctttccggaggggataatgaatggcagcagtgcctatgccgactatgtgagtattccctcatcggaactggcgttaacacatcaggcctatcgcagtgcctcgccggcgcagaaaatggcggcggtgctgattgaggacattgatttacagctcatcgaccttcaccggcgggccgcgctgatgcgcagtcacctgaattaagatgtcgaagtggttgttttctgatcactccttttaatgtcgcttatgctgccgccggtgggcgtttatccacagggttaggtgccggatatgcacccgggctgtggacaacagagaacaaggatgttgctgtgcgccgctttattccgcctctcgcgggagaaggcagaaaacccggtccgtgcggtctgcggccgttgccgtgccttcactttagcccgaccactgcgtgatcaagagatcgcttcgctcgcctcctcccccgttcgcactccctccacggggcttactcccgtcgcgcttccgctcagtcttcgcgtcatcgcgtgcataatcacggctccgctcgattgcgctgcggcctcgtcgtcgctcctgatcactccgcttttcgtcgggctgtcattcaggcacggcacaggccgtatctgtcatccccttaagcgaggcgtttgtatgcaggaaatgaatcaagcccgtttcgtcgacggggacgcacgaatgcgctttttacccatgctgttttccagcgactttttgcgctcagaactcaacgtttatcactaggcagaacgctttctggaaggttacaacggcggtttctgggagtttgtgcagttacccaatggcggaggattcatgcagtcgcctggcgatgagtaccgtttccgtaaccctgaaaactggacggatatgatcgtttcagcggaggtggcgggcatcattctgactgcactggtgcttaatcaccgtagctggatgcacagccaccatgatcaggaagaactctgcgcccacttttgtgaacgttacgagcaactgatggcgtatgcagatacgcacaccgaggacggcgcgctgttccgcgcactggactgattgatcaggggcggtgagaccgtcccttacaggagaaaaaaacatgcatggcaacgtaaatgaagtctgcgcctggctgctggaaaactatatccctgggtgcaccctgactgttctggtgtggacaatcgaagatgtggaagtctgcagcgaagaaatgggcattaccgaacaagagtctgtcgaggtgctcagacgcatctcactggatgaaaactacattgagcacggtatcaacggacagaccgtatgggagcatctcagtaatattcgggcgatgatgcatcaggtacgcgaagtcagctttgatgcacgaagccttcagacgctggccgaagcagcagggcgtttagtccagaccggaggagaagacgaccccagtacgattttgcaggctgttgctcaggcgagaatggcactgaacagataagaagaaaaatgaaactgtcaccgcagaaccgcggcatcctttgccagtacaaagccctgataaacgagcgcagccgtttctgtggtcagagagaactcaggacggaagagatcatagatgaaatctgccattacatgacctgtcagtgtgccgtatatattagcggccactttattttgcagagcggcaaaggttaatcagtaacgttcaggcggttgcggcccgcctgtcagcctgccaaaacctgcgccttcggcggcggaacggcagggcgcgcgcctgacggcgcgatcaccgcaccgcctctgataacggtattcttccgtggtgcttttaccgccattcattccagtttttttgtcgtggtgcgtgaccggaatagccggttatgcgggcgtgctgtcggctgtcatgctccgcacagagccgtctcgccgtctctgcccgggcccgttccggggcagcgggtttccatcttgacgcaacacctttcgcttgcagcagccgtcctggctgcgccgcgcagtcgcgccgtttgcggcgctccacgcaccccgccagtacacacggcgggatgtaaggggcaacgccgtttccggggcgcctgtgtttacactgatcggccagtaaacgttcccgcgtaatattgaatatttttgacaaattgaagttagaactgttaattttcatattgcatacatctgtgctgtttcgtgcggttttgctgtttgttgcgttattacgcatgcgtgattattgaattgagcgagtcatcagcaaacgtggataaataccgcaatcatgcccggctttcgtgaagcgtatttctggctcagcatgtacggtgaatgtcgcaaaaaacacggaggcgggtaaccatttcatatttatcaattttcatgtgtttgcgtaaaatacgacgtgctgtgtctgtgcataaaaataccttctcaggcatcccgtgcaagataagttgttacagacgcgcactatgcgctttgagcatgttgccagtacctgtatgaggttatttaaattccacttaagacacatattcaacaagccacttttagagtttctctttcatcacacctcgcgcaagattttatcttgcatttttatttatttaaaacattggagtacaggaactggtcgaaatggaagttcagaacgaggcgacacactgtgagataaatttctcgtcaatggtcaatgagcttctcggattcggtctgatggtaaagaaccatcagggtgagagcagtaagtttgacactgaggggtttaaccgtgacctcatacgtaaagtttcaggaacaagggaaggaataagtattttaatggcaatggtctaagaaatctacctgaatatgcgcggagaaaaaaacgaagaggcgctggagacaattctggacagaaatctgtcagaggttaatgatgcaaaagacaaggcgtcaactaaacatttcctgcaagaagagtgaattaaaattatcttcaccgcctatatcagacggtgtaattttcagtaatcaggtaaaccttttacaggaaggatgactaaacatgttgatcctttttcaataactgatcttatcctgatattgccatgtaacgatttaatatagctttatgatggtcaggcccagttccaatccctgcagtgtatcttcctttactccctgattaaaaggccagaaaagtaaatctaatttctttatatcaaaaccctgacttgtatcgctaacacgtatgaatagagtgttgtttaataattttatatttaagttaataacgcctttgtttatttttttattcgcattatcaatgaggttgtgcacgatagatatgagatttacttatcggaaattatttaactttcgccattggtaactcttaccaataacttattcctatttccttcgttaaaatcaccctttcaccaatagtggggggatttcaatcgttcctgaagatacttctccggtatcaatgattttaaaaacagcatccagcattgccggtacatcctgacgaatcatagaaatattatgcccaagcagtgatacaaacggatcccagtcaaaacagcccaatggcggttgttttttgttaatcagtccacgctgcgccagccaacctaccacgccttcgagagagatagttgaattaataaagatacccggcaggtgaatttcactattatcaaaagcatcttccagggtcagggcaatgttgccgagagaatagcctcttaccagcaggttttcttccggcacgcagagtccatgggctgcatgagcatcaataaaccccctgagacgctcagcagtattatgatctgttttacgccccccaataaagtacaggggtgatgttgtaccgtaacgggcagtactctgagccagaatggtttcagttaatttttttgcgccagtataattatcagagataatcgacggagccagtgtcccgggtaagtcgagattaattacaggcactcctgcctgctgacaaagccctgtgattttgtccggaaaggtcgccccggtagccacaatccagtccacctgccacgaaagcataacccgggctgcttccagctccagttctggatccctgcgagtacaggtaataatcggcagcatattgcgctctcgtgccatttcttcaaagcgctcggctatcgaaccaaagtagcggttatcgtacctgggaaccagcataccaataacgttggatttttggctacgaagcaggcttgcctgccgattcagcgcatagccctgctcttcggcaattttttttaccctgtccgccagtgatttactgatccgccgtttttcccagctcccgttcaaaattgcgctcacggcactagccgatacgccggtaagtttcgccagatcatagatagtcgttttcttgattttttctgttcgtgtcacaaatccaaccccatttttttgaagactcttgcccacttttttttaaagtgataccacagcttcatcggttgagcgagtaaaaaacagtacgcccccggtttttgcacccttaatgggcgtacagaaacctgatttttgacatataaaaggattataaaatgacctcatcaaattcatccattactacttcccttgaaggtaaggtggctgccattaccggtgcagcttccggcatcggtctggcctgtgcaaaaacattgctggccgcaggtgcaaaagttgttctcatcgatcgcgacggcgaaaagctgagcaagctggttactgaactgggcgacaacgcatttgccctgcaggttgatttaatgaaaccggagcagattgacaatatgctttccgacattattaacctgactgggcgtctggatattttccatgccaatgcaggggcctatgttggcggacccgtagcggaaggcgatcctgatgtctgggatcgggtgctctgtctgaacattaatgctgctttccgttgcgtccgcgcagtcctgcctgaaatgatcaaacaaaaatctggtgacatcatctttaccagttctattgccggcgttgttcctgttatctgggaacctatttatgccgcatctaaatttgccgtgcaggcgtttgtgcacaccacgcgtcgtcaggttgcacagtacggcgttcgtgtcggggcggtgctgccgggtcctgtggtaacggctctgcttgatgactggccgaaagccaaaatggacgaagcactagctaatggcagcctgatgcaaccaactgaagttgcagaatccgtattgtttatggtgacacgctctaaaggagtcaccgtacgcgatttagtcattctgccaaacagtgtcgacctctgagccaggcatagccggcaaacagcaacaattttttcaggtgaagaaagtatgaataacgagaataaagcggttattggcatcgatgtcggttcaggtagcgttcgtgcaggcatcttcgatttggagggcaggctactgacgcatgctgttcagaaaattaatgtctttcgccgttcaggcaaccgcgtggagcagtccagcacagaaatctggcaggcgatttgccattgcgtcagacaatcccttgaaacgaccggaatacgcgctgaaaacgtggcaggactgggttttgatgcgacctgctctctggttgtggtcggtgaaaatggccgcccactcgccaccagtgctgacggtaatgccgatcaaaatgtcatcgtatggatggatcaccgggcgacccggcaggcagaaagaatcaatgccacccaacattctgtactgaaatatgtgggggggaaaatttcaccggagatggaaacacccaaaattctctggctgaaagaaaatcgccgcgaggtttacgataacgcctggcaatttttcgacctggcagactatctgacctggcgcgctacaggcgatctgacgcgctccatttgtaccgtcacctgcaaatggacatggcttgcccatgaaaaccgatgggaccctgactacttccgtacgattggactgggcgatttggctgatgaagatttcaggcgtatcggccaaaaaatgtccgcgccaggtatgccttgtggtgatggtctgactgaagacgcggcccgtgaaatgggactgttggtcggtactccggttgccattggcatgattgatgcgcatgcgggagggatcgggacggtcggcgttgctggcggggcattaagcaatctggcctatgtcttcggtacctcttcctgcaccatgaccagcacccgggaggcggttgccgtaccaggcgtgtgggggccttactactctgcaatggttcccggttactggctgaatgaaggtggtcaaagctctgcgggggcagcaatagatcaactagtggcgatgcaccctataggggctaaagcaacggaaatggccgcgaaagcaggcatatcattaccggtatttctcgccaatctggcgcaggagaaatctgtgacgacttctgctgccgttgagctggctgaaggcatttatgttgtgcctgaatttctgggaaatcgcgcgccgttcgccgacccacatgcccgcgccatcattgccggactggggatggaacgcgatctggatagtctggttgcgctttatgtcgccggcctttgtggtatcggctatggcctgcgccagatcgtcgatacacaagaagcacagggcataaaaacggacagcatcgtcattagcggcggggctggacgtcatccactggtgcgtcagattctggcagatgcatgcgaattaccggtcatctcaaccacgtgcagcgaacccgttctgcttggttctgcaattctgggggccgtggcagcaaatattgcaccatccgtcgtaagtgcgatgaaacaatttactcataaagatcagtcttatttggtaagcgaaacgtaccgcgcaacccatcagcgtcgctatgaaaagtaccagcgcttacagcaaacggccagaatgcttcagacgtcataatcagtaatgacatccttataacatcaggggccggaataaacggaacccctgcaccctacaaacagaggttattatgtcctaaagtaataaacagtggatggggttacaaaattgaatcgccacggataatctagacactttcgagtcgttggtaatactggttttcatattctgccggcgacatctgatcgccagaaccatgccgacgcttactgttataaaacatttcgtagtattcaaaaatatcgctgcgggcttcttcccgcgttccgtagatctttttctttatccgttcacgcttcagcaactggaaaaagctttctgcaaccgcattatcatggcaattaccgcgatggctcatgctgctttccaggccgtgtgatttcaggaacgattgtgtactgactgccctgacccgagcgaaccagcacctgtttttggggattacgctggcatacagccatcagcaatgcgttcaggacaatgtcctttgtcatccggggttgcattgaccagccgataattttgcgtgagaacagatcaacaaccacggcaagatacagccagccttcgtgagtcctgatataggttatgtccgttacgcaacgctcatccggagtacccggattgaactgttgctggagcctgttgggcgacacgatactggcctcgcttttacgtgcctgcgggcttcggtatccgacctgagcttttatcccggcaggtttcataagtcgccagactttgttgactccgcaatgttgcccgctgtcccgcacatccaggtggatcttgcgataaacacagacgcatcccgattccagccagaactgtttgatctgtcctgtcagtctcaggtctacctgatagcgttgtgaatgcagttgctgaagccaggcgtaaaagccacttggatgaacatccagcaaccgacagagcaggcgaacaggccagctaccggtgttgtcacggataaagacgtacctcagtcggacagctttgcgaagtacgtcgtggtttttttaatatgtcccgttcgtcggtaacctgcttcagttctttctggagacggcggatcccggcctgagcatctgacggttctttattagtggatgagtccggaacatacttctttatccaggcgtaaaggctgtgagtggtgatatcgagacgtgttgcaacgctggaaacagaatgaccacgatcgacaacctgtttgactgcttcaattttaaactcttcgggataacgcttaccactcatgggcacctctctttaagccatcttaaatgactctgaggtgtctgttaaacctgtggcgatttattgtgcctcaatagcatcaggtcgataacccatttcgttcaaacgggtactgcctgtggttcgtgttgcatgtgggctatacgttccgctccagccgaggtttttcagtagctggcgcagtgagtgcggtgtcatcgggccacgcgggttatctcgccccgggaagatatgctgttgatgcccggttaatccctgtagtgttctgagcatgttgaccgcttgtgagagaaggggaataacatgttctctgcgagctttcatgcgcgcagccggaatggtccacagtgcattaccaagatcgaattctgcccattcaacctcggtggcttcggctggtcgcgccagcgtccaccacatcagccacatgcaatagttaacctgatacgagccacggctgttatcaaaacagcttaatagcttcccgatttgctgaggatttagtgcctgtttgtgctgtgtcttattagccggaagggccttgcgcacaggccatacgggatcgctatcagctctaagcgtcgcgactgccaactcaaaaactgatgaaatggtgcgacgggcttcagcggcaacagtcggtgctcctcgtttagccgtttcctgaagaattttaagaatgtgatgtggggttatctctctgacagcgagcttaccgattgcgggaaaaccacacgttcaagcatatccagtcgccgcgttttggtgatttcggcccagtctttcatctgcaaccactctttggcgatcagctcaaaggtgttagaagcgtcattgacattgcggatcttatctaactgacgagcctgtgtcgggctaactccatctgcaacttgcttacgcgcttgctcgcatttctcgcgggcttctgcaagtttaactgtcgggtattcacccaacgcaaacatgctggatttatcgttgagtttacaccgatagcgccatgccttcttgccgttgggtttcacttcaaagtgaaggccattaatttcattgagccgatagcggcctggcagtgcggcagtgcgtatcagtgagcatagcggggcattgtttatttcttatgccgttattgggcccacgtaaaatgagatggaagaatgttgtactcatccatgtacgcatttttgaatgcgctgttacgagatgaattgagatcttataaaatgaaaaatccacgcaacggcgtggatttaagagcattcgcgatgtttatgagattcaataaaacctcataaggtaataagggcgatttagacgttaaactgttattttttcatcattttattgatttttatggttttaaataaagaactttgtttttgtactcatcgttgtactcacttttgagttcgctaggttcccaatgcggtgatcgtaggttagactgcttgtatgggtaatataaacaatgatttaataaaattctcttcaaaaatcttccctcatctcacgtacttatttagcacgatataacgccaaggataattaccctaatgaaaccgctactttttggccgttggctgaaattcagttgttgcatatagtggtgtaacggcataaatactgggcaagatgatgaaaaaagaagcaaaaatgctagcgctaaggaaatggttcaatcctgataactatgacgctttgaatgatataaccatcgaaaaactccaccaggaattcagatacagacatcaaatgtttgtaggttttaagacggcatccgaagatgaactcgaaacggtcaatgaggaagaagaacagcaaattttttcgggtaatcctcttcttactgtttcgttaaaggccagggaagcctctgcctcagaacacaatttagaaagcgatcagcatatcaagcattttcctgttggctggctttaccaggctgaggatatgatacttcgaagtggaatcgtacctttctctgagtccaaacgcccgaagactacttccccctacgccagctatcctgtctcgtggttttggggacacaaaaacgaacggttgaaaggtcggatggtgttacacctcgatctaagtggttcgacagatgatgaaatcatagaatctgtccgttatcttctgccaaagtggcgaaaggcaacaggtgtaaaaccacatacccaaaaacagacgttctactttggtgaggtgatgatcaaaaaactcattgatttccgcatcatccccctcctggatttactgtattggtcagaacgaaacgcgataaagctcagtgatgctgaactgtctgctctcatatacagggttggtatcgatacggttcgtggtgactcacaaataaaggaaacggataagccgatggctctaaaagccagaacccgtgagttcaacaacttgttcacggcatttatctataaaaaccgatatttgatggatatgaaggtttctgctgtaatggataagctgaaaagcgatcagaaatcgaaaaataaatcaagggatgattaaataaaatagttccccggacagttatccgtcgggttaacgggggggattatgcaggagttcgtctcagacgatctccttttttttggtccattttttggcatagctattcacaatattattctccacatcaagaaaacaaaggagaaaagcatgaatcaaaaatatgaaaaattcattcgactgtcagaagtaataaaaagaacaggtataagcagatccagtatttatcgactggtaaataaaaataaatttcctgcgccagtaagaataagcgagaaaaccattgctttcatcgagagtgaaataaatgactggattgaaaacctgattaattcttcacgcaataaagcagcataatttaaattaacataaaaataaaagaggtatctatgagtacattaattaaaaaagcaacaagagaaatggataaactggactggggttatttggatatactagcagagtacttatacactccgcactggattgccgatttcgacgataagaagagcaagttttacaatataatcataatttatcgtgatcttgatcgctttggtcaggaatcattgaaaagctatctgtcgtatagaaaaaataaaatcatttcagaaagataatgatagaaatcagattttaaaaatggtgagtaaacgccatatggctggcgtttacctgaaaaaaacaataggaaaaataaaaatgaaaacgttttatataagaagtctgtgctttaaaattaatgttaatattttagatgagttttacgaagatgaactaatacgtgcagtaagacggggtttggataaatggattacggatacagggatctgggaaaggacaaacaaacagaaaaaagcgtctgacaagatagctttgcaggattatttaaataaatatgcgatcaaggaatcgcatgttaacgcagtagaggttaaagtaaagatcgtgtgggatatgccgtgggctaggcaatagtgtggaacagcccgaaacgggctttctcacggtttcaataccaaaaagtgtggatgaacggcgtgctaagcactatgaagagatcagggaggcggctgcacgacaggtgaaaatcaagaaaatgatttgtcagatgaaaagggatcggatttgttgctttattacggttaagcggggtagtctctgaggaaggtctgttgtgtgccaacagcggacatttgtaatatttggttttatcaatcatcaagacagttaactctaattaatatattttacatatatgatattctatgaaccttagcgagttaatccagactaaccatgtagcatcgttagttagctatagttaacgatattttgagtgagtgtactattatcgcaaactttttttgataattaaggagcggcgtgttgattaggaattttttaagaaacattaattgggaagcaagttcagttattcttgccatgatacttttcattgggaacataatttactcacgttaccaagatggaatgaaggtagagtctgagaaaaacaacattcgcacaatgcttgcctatgaaatatctaataaccatcgcacactcagctttcttgataaaacgcgcaatatcggttttgacaaaaatgcggaacatataactggcgaacctttcgctattaatctcaaatcattaggaggacctcgcttaacaatcgcatcgaatcagaccgataaagttttcaaagcttacttcagtgagctaagcaagcttgataaggaggatatcacacttctaatggactattatcatgagcaaagtattctaatggaaggtataaaggctacgctaaagaatatgaaagatagtaagagccttgatcttgaaattgaaggttactcattagagcgccacttccttaatgaactcaatctttcaaatattttactcaaacgctatagctacttattagccgagcatccgaaagagcctgaaatgaaagaactccagaattgacgaactatcaatatttacttacgggctgattacgcgctatattcatcccgcttaaccgagctattgcttttagaacatttcaggagagcgtttcaggtagcctgtaaggctaatgtccgttcatcgctcacagcggtcagtcagcctcaacaatcggcaggagtatagtataaccgctttgtagtttgttattagctgattatggtaagaagctgcctgttatcaaaaagctcaaccagaaccgcttccaacactgctagttgccacatactggacaggtaaagctcctccgttccggttttgcctgtgaggtcttctcgaactactaccatgacagtgctaaggatctggtctttacatgtcagcagtttttctttgtccaaaaaatgaaaccgacgaccggagaaaatcattcttaggtagttcagataattatcatggaactggtcatagtggtagccattagcggagtaataacgaataagtgattttgttatgacgttggctataccgtcttcgtcggtatgaatgtttagtatttcgtttatttcgtttatttcgtttatttcattttttagcatttttatctccattttttatttttatttcttcgataaatctggctctgtcgccattaaataccaccgcaggattgatatagtaaatgtacttggatttgcttggtgctatgatctgcttatctataagctcttttattcctcgataaaatacaggatcggataagttgaaatcacactgacttgctatatcttttgctgtttcaaaattcatataaacctggtctttaccaatcgcgtcagaaatggaaaagagaaatatgtaaaatagcttattacctgtcagggaaagatcaaagagaacacggattttggaaatgaaaagcttaacgaacttctctttatcaacttcctgtatagagtgaatgacactttcgtatcgttctccctctggtgattcaaatttttctccacgagctactgttcttcttttatctttcgtctggatctcaatgccattttgcaatataaatgggttcttatcataggtgtttttattcatcatagttccttttttattattataatacacatatataactatgttttttgaaatgtcaaatatattttgaagtattttcttcattttaatgctcaggaatgaagagaaatacaacaaacccgaagagaaaaataacaaacccgaagaaagatctacaaacccgaagaaaaatcaacaaacatgaagaaaatgactttttaatgcattgttttatatgaatatttttatcttaagaagtataggaaatataagatctaagaggacaacaggaatcctgtgcgatcttaatatcgccacaatgaggttccgactggaataagtttacttaaactggacgtcccgccagttttatttatcaggaaaacgttttccttaattgttttattaaacccctgcacaacatgaggtcgtgcctgtggggttcatggtagttgaagatcttcttttattcagtaacagaagacaacaacagagcatttgcttctttgccttctaggggcaaccagcaatgccggtatgggctatatgagtaaaataatagttttactgagctacatgctcgcttgctcgccctacgcaaaaattaaaaccttggataaatggctggtcttgattgagctaacgcgctcaatcgctaaaacctggctctcgccctttttatttaaattgtgaggacgtttttcttcacctgataaagtgatttacatcatttatacagtcagaaatgaagaaaagtcttcacgcgatgaagaaaatggtttcaacagaaaactcatgctatttaagtcgtcagtgcgcgtgagcgcatagcggttttgctgacagcaggaagcaaaaacaagacagcttcctttatcaaaggggtttgattttgaagcagtatatgagcaaactaatgtgctgcattgaaaaactaattaaataacaaaccatcattccctggtctgctggttgcccctaaaaggcaaataagcagagtccaggattttgtgttctgattataaaataaaagagaagtaatgaatattaaccccaatgacacggcataacagccgtgttgggttacttaaaatgaaagaaaacaatattttttttcactttataaaatcaataaagaacatctctcgcttcactctatattaataatgaagaagaaaactgctctcaggccagatatagctcaaaataaagtccgcgatctcggaagttaaagtccgcggtttggggactttaatcaataatcattctcatcatgaaaagcaaagttcatttttattcaaacttttgatacttcaaatgtcaggtgatgaaacttaatatattattttattaaaaataaatgtactttaagtattgactaataaaataaatgtgttaattaaaatacaataaaaataataaaaggaaaataaaatgacacaagagataacgaataaatcaagaagaggattacaacgccatgtgaaaaacccatttataatctctgcgagcaataatacaaaaggaggagtaaaaagaatatccacagggaaagacagacttatggttgtcaatgaaaacacaggagaatgtttaggtggggctggtttttttcaatatcaggaagtggataaaacacaatttttaaaactctatgttaatggcgtcagagcgattactgaattatcttcggcagggacaaaggttttcgaaatactgtacagagcaatgcaggagcagaaggacactgacacaattttaatgtcgtatgatattgtagataaaacgattgttaaaatatccagaacgacttattttaaaggtatgaaagagttggtggaaaaaaattttattgctgaaactatgatccagaattattacttcattaatcctgattttatattcaatggtgatcgcctgtcatttgttaaatcttatattaaatgcgaatcgaaaaaaatcaacctaaacaaaagccgttgctaatgtaaaaactgtaccttaatatattgcctatattaaggtacagttcaatttactacggtagtttatttattttattgaatatagagatgttttacaaaaatgccgtttcactactgccaattttttctatatttccatttatcatttttacaccaattccatgttcactatcaatttttgttgagaacataaaaccatattcattttctttatctgggaaagtgtacattttaataagtttaagatcagacggttcttgattgtaaatgttgatacaatactcatgcactgctttttgaattttttgtaaaaactcattttggtgattaattaaacaaagtatatcatctttcatctttttatctgataattcagattcaagattaacacattgtacttcatccggaccgaatgctttcaacttcaaatcgacagcaataccttcatcatcttcataaaattttaagtcttctgattgcataatgtacctcactatttacaattcaatgattttgcagttttcttggcttcaagtgattcatatttaacaccatgatactgttcgtattggctcactgaaccggagtgagggaaagtggcttcatgagcgcttgtctctacaagttgcatggtagaagtattcgttatgggatcataatcatttaaatggtgccaaatatagccatctggatgtgatttacctgtgatattcccaactgagtttttgtaatttgccaattcgtttgctgccttaaagtcgccataacgactgcctgtcattggtatttttacaatattttcaccatgaggataaagtgcatcgcttactgagaaatcgaccccagtaattcaatctggtcctgtaccgtaaagcgtgcaatctggggatcgtaataccggaaaagataactggcgatttgtctttttggcgaacatggactggtgcagttccctgatgcaccagtttaggatgtgataaatcaattttttttcagtttattaatgaatgatgaaaacgacgctgagactatatctaactcattttcgtcaatgagccagatcttcacttcaccataactttctgaaacagtagatattagaaacagatttccaccatcatcatatgcgaatggaatcatacctaaaagattaggccaatcttctaataattctttgtagcgtttttcaattgggagtttcccatgggaaaatgaaaaaaagccaccaagcagaaatgggttaggctcattttcttcgggcaaatagccaccattatttctcaaataaaaatcaataaaatcctttggtaaagctatcttattagaagtttcaaaatttcttatatcatctaaactaatatttttttccgattcttccaaaactaaggacatgatttttttcctccgaatctcgctgggtgtgtatagctttttccagtagcagctttatattgacttacaccgccgctatggggaattcctgaatgcgcattctgttctacaagttgcatcgtacctgtgttggtttttgggtcataatcatctaaatggtgccatacatagcctcttggagtggatttttgattaagaccggcgatttcatttgctgactgaaagtcaagatcgtaatccccagaataacttatagttacaaccggattgacatccaatctcttattatacagagcatcactaagagagtaatctaagccccctccctgagttcttgtaacaccgctatatcctctgtcttgaattctggcaataggatcaacagctaatccaagtggatcaatccatcccagcggattcggtgcatactgataaagattccagcctcccagtaatcctatggggtcctgtaccgtaaagcgtccaatcttaggatcgtaatacctgaaaagattatagtgcagacccgtttcactgtccgcgtactgcccggcatagcgcagtggctgatgaacaagggcagtttgttgcgtgaatctgtggaagccttccgtctgtcgtgcaacctcaccaaaactcccgtaatgaccgctccaccggagttgtccctgttcatcagtgatatccagcggtgcaccgttcagatcggtgctgaaccagagaacctctccgctggtttcgtcacgcaaatggtcaatacgcgccagcgggctgtaagtttcgttcgggtcgtaaacatatgtctgacactgaccgttatgttgctgctcctgcaacagtcgcaagccctgcaacagaaagcgggtctttgtggtgccgtgtggcgtggtgaccgttttgcgtgtgcggcggcccagggcgtcataatggtagtgcgcggtaaaattgccttctggtccattgccctcggcccgtatcagccggttttccgcgtcatattcataatgctgttcatgcaggccgctgcgacggctgacaaggttaccccaccagtcgtatttcataaacaggttctgccagtgcgtgaggcggttatccttcagcggcagagcagagaggtcattatccggcagcaggttatccgcagcgtcgtagcggaacgtcctgttgctgtggtccgggcgggcttcgtagtgcctgagaaaacggccttcctcatcatagccgtaaattgtgttgccacgcagggtgtcactgacgtctgacagttctcgccgcccggtgtagttgaaggcgcgttcgaagattgtctgttccggcaggtcgggtgtgaagctgctctgccgggtacgtctgcccagactgtcatactggcgggtctgctcacgggttccctgagtgcgggccacctccctgtgaaggcggtcgcgtgtaaattcagagatgatttgctgaccaaaccggatggcgctgacgtggccggaaccgtaatgcagccagcttatctgctgaccgccgggaagggtcagcacagtgagattacccagaacgtcatacgcagaatgcagttcaccgttgactccctgttcagcgagcaggtttcctgccgcgtcgaaggtaaactgaatttcatcttcttcaattcccagcgccatgccatcggcggttggcttgcgggtcaggccggtaagctgcccgctgtttttacgctggtaatggtactgagcatcgcgggtagtgcgtgtggtcagcaggccgctgctgtcatagctgaactgctgagcgcgtcgtgggatgccgccatcaacgtctggtctgccgttttccatcagcgtggtgagtagtccacgttcattccattgcatatgccgggatgtatcgtccgggcggacttcgctcagtgggtggcctgtcgggtcataagtaaaacggtactcgccaccgttgccgttttccagacgcagcagattgcctctcgggtcatagtgccagcggcgggttcgtccagtgcggtcggcaacgctttctggcagtccaagcgcggaatactgccagcgaacctcactttccagcgggtctcgccaggccgcaagttgcccgtgctcgttccatcgcagcgtttcctgactgccatcggcacgaataacggcggtaagctggcctgcatcgttccattcgcggcgtgtgaggttgccttctgcgtcctcactggtgataagctgaccgaaccggtcatacgtaaagcgggtcacgctgccggagcagtcggtgcgttgagtcagcagtccctggtggttccataccagcagcacgtcaccaccactggcatcggtgatgcggtcaggcagcgtttcttcttcatcagggtagtgatacgtggtggtgtgattcagtgcatcggtttccgacagcaggcgaccgttcaggtcatacacagactgagtggctgttgaatccgggaaaaccgtgcgggcgattcggtcagtattacggaaccagtaatacgctgtggtgcggcctgccgggtcggtctctgacgtcaggcgaccgtaacggtcccactgactgcgccgcatggctccgtcaggcaggataacatcgcacaactccccatcacgacagacgaagccgatctggcgaccgtcataatctgtgaaacgtgcaacattgtcatcgtcgtcaagcagccagtgtgcctgtgcgccatcttcgcggatggcgcgacgggtgccattcacaaaatcgtattcaaaatcaaactgctcgcccgcgctgttgcggtaagccagcacgcggggcagtccgtcaagactctgccagagatactcgttcagcagaccgttgctgtcctcatggctgcgcagtaaatccgtgccgtctccgtcatcataccagccaaagcggcggcgtacctgaccgccgcgtccggtgacgctaatcagccgggccttagcatcgtaatcgtagctgaccagacaaatctcatcatccagccaggctccggccaggcgaacctgtccgctgacggtctgataacggcagaccacgcgctgtccggcgctgtcggtgagtgcatgcagcgtatggtcgtcgttccagtcaaaaagaatatcgttaccacaaggttcggtgagtcgcagcggcagggaaggggaatcaccctgcagagatgcgtaacaccagcgttcgccgctgatgtcatacactgaccagctgtcatcctgatggtgttcaagccagcgcttctccggttcacagaaggttcgctgcccttttggcacgagaggaaaggacacataatcgccggacggtgcacgccacaccagcccgtcctgatatttttccagtcgcgtttcccagaaaagtgaccagccacggcccagtacgctgtcgccgggattgccactgcgccagtaacgctgccagacaaccggcagacgggagggtaatacaaagtccagctcgtcatcaccggagaggaatttctgcccactgacgatatcaaccgggcgggcgataatgcccacggcggcggcgctggtcatcagcacgccagcgcggcaggcgacgcgggccagtttgttgatacccggaattttactgaacagccttcccagcgcaccgactttacctgccgctccgcccgctccaccgagcagtccggcaaataacagcgtcaggtcagaggctttatagagccattccgggacttctgactgtattggcagtgtctgttccggctcaccaccaataatcacatctgaggaaccggtcatgacctttccaccacaggtggtctgatcgccgagacgggcagcaggcaggccattgatgtacacgcgtgaggagccttcggccatctgctgtgaaccagcatctttggcgcattccaccatgctgtcggtggcaagggcggcaggtctgccattaatgaacacattatgagagccggtggcgataacgccttccttctccatgctggcggccccggcatccgcaatgctgtccctggccttcgttgccagttcgcccgtaaaatacccaaccgccagactggccccgaccagaagcacaccaatacccagacatgacgcaccgataccggcaatcatcaatgccccggcggcgatacctcccgctgcggcaatcagtccaccgacaatcgttccggcaatcatccctgccagcgcatgagaatggccaatatcatcacccacgcgcgccgcttcgaacataacaacgttccttaattgtcaggtgttaaaagaaaagctggcaagcagcgcatggaactgttgactgtctccgtccgtcagtatcgcggtgcaggacacagtgaacaccagaatatggtttgcagacgtgttaaataccgcctgttgctggaagacccgtttaccgtcacgcagatagcatgcatgcacacattcaccctgcaagaggttattgccgagcacagctggcacccgtttagtttgcttccagcctttcagatgcttctgcatcagcgttaactgccggtcaatataacctgacagcgtcacgtcatcattcatcgaatcgcgggagatgttaaaggctggcgtgttctcaccgggcagggtaaagacattaacggtgcgatcctgatagtggtcaggaagggtgatgtggccttcggtaaaaacgcagagagggagattatcagacattgagcagcttccatatgcatcaggacggtttaagtgtgccacagggccaggcagcttgctatacagaggtttcatttacttaccgaaggtaaatgttctgagataagtatcggttcagcaacaggctgattcagccgatgcccgctttcgtagtgcaaaatcagtcaattaatcacacatttcattaacttattgatctgtattgccgatcgatatgtgcatatttaataggtattaacaatcgataagctcttatcgatcggtaattaattgccttaatcgatcgatatatttgttttgatagtttatatctatcatgtgttgtggatttgatcgataaaaacgatatgacaggccctttgttcagatcaattatatcaattacttagagttaatctggcgaggaaaagagcatgtcagaatgtccgttttgcggtacagaagttcaggagcatgtgtcagtgtgcaggggatgtggtgctgagagggtaaaaggctacgtcagtcagcagaccatgaaagggctggtagttgttggaacgattattggcattcctacgggatttgttatggcctatctcaccaaatccacgccagtaatggtgataactttgcttgcgttaatgcttggcccattactgattctgaaatttaaaaccaaagataaagtcagttgggttcgtccgaacgcacgttaatggctttgccaatatcaggaaaaacaccaccactcactgttctgaatgaaaatatcagttcagtgagttttttataatccttttcaggctacttgaaatgaataaaacgatcaccgctttgttagcatctgccgcttttacgctcgcaggttgtcaacagttaaacgatgcaacagggaaagtagggcaatcgatcaactcatccttatcttctctgggcaatgctttaagtccttccggtagtaaaggtaatacaacaacagcagataaccttcctgttaacaccgtcagcggtctgggtgctatctgtcgcgattatgaagcaaatgctatgtctggaaagaagaactggattggtaagaaagtcagcatcagcaatgccactgttctggaagctcaggaagcttacgacacgatgaaatacctaggtgcgcagagagaccataaaacttacgccattatcttccagacgcctgatacaaactactgcggtggggctgtgctgttgtcttattatccagggcaggatgacgatatcctgaaaattaagaaaggacaaaagatcacgattacaggcgttgtttatgatattggcgacaggacgtttaacacgcataataatggcaacatggcatggaaggtgataaagatgaaggacggtattatttattaaacttgtatgaccttgctaaaatgccatctaataaaattaaaaataaattcttcaaatatattcaggggaaagatctttagagtctattagtcacaacttgatcagacatatggacttgaaaggttgagagttacaggctttgatatggatgacgaagccttatacaaaacacgagataactctcatgctttaaactactaatcccgtcatcaaacacaaagtaagtttgctcaacctgctaaaatcatgagcgtttcgcaggatacactttatcgtaattgtgaactggtagataaaggcggcgttgatgaaatgatatctattgtttctatattaacgttaaaaattataatcagcttgttgccagaggatttatgcaggaggcatttgttaaaagtgtagggggtgaaattttcagtctgacaaaagaaagttattaagtgatattattaaacacttcggacgtttaactttttcaggaaaattaattgatgttttttaatacaatcaagtatatacattttaaataaaggccagggtgttaatatggctggcctataaaagatgttagcaggttttagtggcgaggttgatcctgcttagaatctttcttttaattatcaaaaggttagatgtatcaatctttcttgatactctcatttttaaagataaattatttactttatttggaatcgcatttcttatttttataaataaaagtggtaaagtaaagtcttttgcagatacatattttaaggcgaaacacatatctctatctatctttgattttaactcatttattttatagtcaagatatggcaaggataacttttctgaaagttgagaatatattgtatttttaagatctgcaatcttcgttggatcaatatcaccattcccattttttattatactgttatatccataagaaacgttttttatacctgtttccattgtgtggcaaatggtaaaaagtataaataaaccctctaaattttctcttaaacttcccatgaaagaatcaaactctataaagtcattttcactattttctgtgaagcaatttatttcttcgcttattatttcattcaaagaatttttatcagtcaagtaattttcaatgcaatatctttcaagaacgataacattatcaggtatatcgtcaatttcaccacctaaaatataaagatcaccatctactataaaaaaagcatcaagactagtgatatttttccttgccgtatccaagacctctttacgagagccaatcggaaatattttttttatacggaaattatctaaaagatttgtaagtatgttttgatatattctatcataacctggtgctgtgtcctcgatataaatattaatatcgtttaattcttgataaaaaaccggcattgctcttttggctgacttgcttctctctaacatggcaatttcctgtcactcactctttaaataaatgcaattatcatacaaatcaccaactatttcaggtgagtgagttgcaaatatgtactgaacattatcatttcctttcactatatttttaattaaagattcttgccagcttaagtgtaaagataattccggttcatcgataataaatgaacctccatttttaacgccaaaattactgtgtgaaagtagcattaataattgcttctcaccagatgataaagtttctagttttatttcttttttgccacgataaacatttatatttcctagatcatcaatatttagatacttaccggagctaatcaaaaaactattaatagagtcagagaaatcttttataggtttgtatctggcctctgcaatttttttgtttttatcaaattcttttaataattcattaagaccatttgtttgtattaaattaaagcataaatcaagagtaagtttacgctctttttcatacacatttttatcatttcttaatgctagtaataatttttgtaacttatttttatacgaaccagttgggtctattttatctacaatttgatacagctcttctatacgatttaaaatcttaaacatagaacttacattttctgatgagaaatagctatcaaaatcaatagagttatatgataggaatgaatcgaatgctatatctagcatttttttgttcgaaagttcttttgaccttttgtacctttcgaagtgagagtcaaaaagccttaaacacatatcaagagcaagatcttcacttttagatatgttcttttttactctataattactggtgtaatcattatagtatttacctaacgtacgttctaaacctaaaaaaataggcttttcaatcccattgaattttgaaaatattgaatttgtattaattagattgaatctttctcgttcaaagtagtttgtgagatcatcttctgtaattcttgagtttaggagcgttctgtttctattttgaaaggctctttcattgaaaattactgtttcagagttaccatttatgctaaatactattttattatcactttttgatgcttaaatatcatatgtgttcccagcattagagataacgattacttttgcagattcgaatgttagttttgatatgtattcgaaatcaaaaaatataatagcttgtatcaaccttattgctgttgtcttaccgctaccattcaaaccgactagaaacgttattttttcattaaaattaaaattaaaattaaaattaaaatcataaaagtcatgaacttgtttggctacaaaacttttgattatcatgcaactactccattatataaattatttatttcgagagttcacttgctagaatttcagcctgcctcaaaacagtttccgtagccagcaatgacatatcaggcggatagccatattttttgagcagacgttttaccaccacgcgaattttcgctcttgccgcttctttcactgtccagtccagactcacattgttgcggatagcctccgtcaggacgactgccaattctcgtagtttttccttttgcatcagttcacgagcgctgtcgttatctgcaacagcagaatagaaggcgtattcgtaggtactgagatttaactggctggcaaggctgtcggattcctggatagttttggcaagcttgatgagttcatcgataacttccgcagcggtcagtactttgttctggtagccattgattgcagaggttagcatatcaatcagttttttcccctgggtgatactctggttcgagcgaatcttgatctcatcagcaagcaactttttaagcgtttccagagcaatatttctgtgctgataatccttcatttcctggagaaactcatcagatagtacagagatatccggcttctgtattcccgctgcgtcaaagatatccacgacgttatccgtgaccagagcctgatcgatagtctgttttacccgcacttcgagactgtcattgtgctcttcttctgagccgtctgggttttcagtaaatttattcaggcgagctttcactgcctggaagaatgcgacttcgggtgccgcttccattgctttatcatgtggcgtagccagcgcaaatgcctgggacatggcagcaacagcgccaaggaaacgcattttccctttgccgttatccagccctaaaatatggttttctgattcaaggataatcgtcaggcgctgtgaagtcgttgcagtaaagtaggctttgtaatcgtaaccatgcatcatgccttccaggatttccagtttttcctgcatgagcgtcacggcttcttcctgaacttcggctggatcaccgcgtccacctgcgtcagagtagaacgagagggcttcttttaaatcagaagcaatgcccagatagtcaacaaccagaccgccgattttgtccttgtacacccggttaacgcgggcaatggcttgcatcaggttatgacccttcattggcttgtcgatatacagggtatgcatacttggcgcgtcaaagccggtcagccacatatcacgcactatcaccagtttcagcttgtcgtcatcgtctttcattcggttagccagaacctgtcgctcttttttggtggtgtggtgtttagcgatttctggcccgtcagcagcagaagacgtcatgatgacttttattacgccgtcatttaaatcatcactgtgccattcgggtttaagcgtgacgatttctttgtaaagttcagcggcaatacgtcgggacatggtaacaatcaagcccttgccatgatcggcattggactttaagcgctgttcaaagtgctgaaccatatccgccgcaatggctttaatacgttttgaactgccaatcagaccttcgattctggcccatttagaacgttctttctgggtaagcgtcagctcgtcctcgttaaactcatcgtcaaactcttcgataagctgtctgccttcttcactgatggcaattttcgctaagcggctttcatagaagatacgcacggtggcaccatcttctacggcctgtgagatatcgtagatatcgacatagttaccaaaaacagcaggtgtgttaacgtccgttttttcgatgggggttccggtaaagcccagataggtagcattgggtaaggcatcacgcatatatttggcaaagccataaacggtgcgtttgcctgttacattgccttctctgtctttcacgtcaacttctttggcgctgaaaccgtattgagatcggtgggcttcatcagcgataacgacaatattggttctgcctgacagcaactcatagatattgatgccatcatcaggctggaatttttgaatagtggtaaacaccacaccacccgaggcgacccgtaaatattctttgagttcatcccggttatcagcctgtttcggtgtctgtcgcagtagctgggtcgcggaagagaacgtaccgaatagctgatcatccaggtcattacggtcagtaatcaccacaacggttgggttatctagcgccagcacaatcttcccggtataaaacaccatcgacagcgatttccctgaaccctgggtatgccagactacgcccgctttgcggtccccggttttttgcgcattaacaagctctttactgttacgtccctgttggcgcactgcgacttcggcagagggggagtccgtattcaccgctgatgcacgaatagttgaaagtactgctgcattgaccgcgtagtactggtgataagccgccatttttttaacagtacggatactgataatccctttgctgtcttcatgtttactggcttcaaacacgataaagtggcggatcatatccagtagcgttacaggattaagcaacccctgtaataagacttcgagttgtggctgggtactggtggcttgcgttttaccgttagcggttttccacgtcatataacgactgaaatcagcagaaactgttcccgctttggcttccagtccgtcagatatcacattaaaggtattgtaggtaaacaagccggggatttggttctgataggttttaatctggttataggcacctgttaccgtagcattttcgtcagcggcatttttaagttcgataacgactaagggggtaccgttgatgaacaaaataagatccggtcgtcgggtatggttgccttctttgatagtgagctgattaataaccagaaattcattattcgtgggatcgttaaagtcgatcaggcaggccagctctccttgtgtattaccatccttactgacttcgatattaattccttcggtcaacaggcgatgaaaagccagattgtttgccatcaggtcaggtgtgctgatctgcatcacctgtttcatggcttcctcacacttctgttcgctaaggtgcggattcaggcgttgcagggcagtatgcaccttatcttcaaggataacctgctgatagctacgtaacggattgatgccactgggttcaatgtccgggccgtaaacatactcatagcccagcccttgcaggtattcaatcgccattacttcaatatcggattcggtcatctttgccatgcgtactatccttattgccgctaaaccagagagccggttgtgtaccagcttaattattttatgccactgatgcgatagcttcttctgtacattgaactcgtacttcaccactcataagtctggggaggagagtgtctcgcagagattcaatgtttttaatttgtgaattgttaatacttatttttttccagaaggaatcaatatgtgcagtgaactctttcaccttatactccggggggagtttaaattctggtcgttgtaatccgtcagccgacagctgatttacagttgaaccgtttgttgcagcaacaacttgctcatgcatatctttggagcaaagtagatagtacataaaggcattagttaagtaactatcgtcattaatattaattttgaataaatgatgcgtatagattgatagttcacttttagttgtcggaattatagcaggataaccgatgagtcgataatcatgaccttgttcagtattagctacaatgatttccccagactttataatatgtctttctttaaaatcaccattgtaatatttcaaaccagtacccttataaccacctccctcaagtactgagttcaaattaaaaagtggaatgccattatctgacgtggtaagaccggttcccttgtaacttaatcccttagctactgtaatatgacaatcgagagtcgttagtttccaatcagcctgtgcctcttcaataaaccatttcctaaacatggtttcagccatagattccatcgttttattttgtcgatgaagaaggtctatttttttatcaagagtggatagcaaagaagctatggctttttgtatagttaaaggtggaataatgaatggatatgccttaatctgcttcccgctgatatgaggaactgctgtaccagtttcaattgaacgtacatattcggtaaagctttttgatgctataacatatttcaagaagctttgatttagagttttttttgctctgaggcaagcgactcgctgtaccagtaagcatggtaaatcatgtttggttatcatagcatacttaaggccggcctcaatccaaggacgatccattgcaagaataatatcattttccttaaggaaatagttctcgtgtaaagtctcaatattttcccaaaatttaactttgtcccatttaaagtacccttgctgtatattgtcaccacgcaaaagcttagtacccgaacctgattgagaataatgactacttttaaatgggaaacctgtaactaaatcaatatgatctcccagataagtttcttcccacatactcataacatcaccttcgccaaattttcagcaatcgctttattcaaaagagcttcttcaccaagttgtgcttcaaactcagctttaagagccgtaaagcgttctttaaagtcgaaatcgtcttcttcatcagcaagcccaacataacggccaggtgtcagcacataatcgagtttagcaatttcattgatatcgacagatgcacagaaaccagccacgtctttatagtcgccacctttgttacgccagttatggtaagtatctgcaatggtcttgatatcgtcgtcagaaagcactttgctacggcggttgatcaaatggcctaagttacgggcatcaataaatagaatttctttactgcgatcacgatactggctgctgttttcacgatcacgacgcataaaccataatgcggcagggatctgggtgttcaggaacagttttgcaggtaagttaacgatacaatcaatgacatttgcatctttaaccagcgccgcacggatatcaccttctccagaacttttcgaagtcaaagccccttttgccagcactacgccagcctgaccttttggcgacaggtgatacaggaagtgttgcatccaggcaaagttagcattgccggcaggagggataccatattgccaacgggcatcaccacgaagctgctcaccggaccagtcggaaacgttaaacggtgggttagcaatgataaaatcagattttaaatctttatgagcgtcattaaggaatgaaccttcattgttccagagaacgtgttctgagttgatacctcgaatcgccaggttcatctttgccagacgccaggtggtctggttggattcctgaccataaattgaaatatcgtcgatttttccctggtgtgcttcaacaaatttttccgactgaacgaacatgccaccggaaccacagcaggggtcaaagacacggcctttatagggttcaagcatgttaaccagcaggcttacaatggattttggcgtatagaactgaccgccttgtttaccttctgccagtgcaaactcaccaaggaagtattcgaatacgtggcctaaaacgtcagcagaacgcgctttggcatcgcctagtgcaatgttgccaatcagatcaatcagttcgcccagcactgtggcatcaagattttggcgggcatagactttcggcaacacaccttttagctctgggttacccgcttcgataagttccatcgcatcgtctaccaacttaccgatttcgggaagtttagccttcgatatcaggtaactccatcgtgcaagttcaggaacaaagaacacgttataggcagtgtattcgtctttgtcttccgggtcggctcccgcgtattcgccttgcccatcttttagcaattcataatgcgattcaaaagaatctgaaatgtatttgaggaaaatcaggcccagtacgacatgcttgtactcggcggcatcaatgttcttacgcagcttgtcagccgctttccacaggatgacctctaacgggtctgttttgatttgtttgggttttctagccattacggtcattttccatatacggacgattgatctattttgccttaaagttcctgttgttacgagcttatcaaaggattattaatcactctgaattgattattttgattaaaaattattcatctttgcgcttgctagaaccaaagcgaagttttggcagcgtgaaaccttttgattttgtggaaactttcttttcctttggtaaaggtggaaaggaaattgcttcgcttgttttgtttggcttttgttttttctcaggctcgtggttgtagttagcgcccggaggtacggaaacgtctgctgatttactggtagtccccatagcttcccactgtctgcgggtgatcttcaatttagtaactgggtcaatcatgatctcatcaagcgaaatatccgttaggttttttgcgtcttgctgcggatcgataacggctggcgcggctacggtagtgatagtgggttctggtatggctttatgaatagagtgtttcaccaacacacttataaaggttttgataaaatcatacagcttttgcaatttgatcttatgcttacgtctcaacagagttggttttgctgtttttggcgcaacaccatagtaaagggacatatccttttgcttcgcttcaacaggtttaaagcggcgtttcctttcgggaaaaacaagcacaggctgacgagccgcttctggtgaacgttgtatcggatgcagtggagcgggttttgttttaacggtttcgatacggaaagaattaaggtttacagtcatgagatggctcacatcactgttaaacaactgtctgaaatcgtcagcagcctgttttgtctgtgcggcttgtatctgttctgcggcacgtagcgctttggctcttttggtgtgccatgatttacggtctattcgagtcagcgcagggcggttaagctcaacggctcttgccagttgttcattagctatatcctgtcttcccgtttcctttgccgccttagccagagcaatcgcttcttcacgctgtgctgcaagggaacggtgatccatgcgattcgcagaaccagtacgttcaagtgcacggttagacattctggaccatgacgcacgccattcatccatcaaatcatgctcgttccagcttctgttcttgttgccgaaaccttgtggtgttatctcacgcaaagtaagcatgacgtgagcatggggattatgaccgtcaaggtcatggaaagagatatcggcaatcatgcctttgctgacaaaattacgtttgcagtagtttttcactaacgcgattttggcatcgttatccagttcaacaggaatagctatatcaaaataacgtgagagctgcgcgtctttccttttttcaactttctcaatttcattccacaacacagcagagttttcaataatattaaaaggtgtgtgttctggcgcaagaatacaatggtggaacaggtcggaacgatatgaataatcgtacacgtctcctgttctcacatcttctattcttcctcttgcgttatatgcggcaagataacaggacgattttcctgcggatctttttagcatactaaatgataaatgaaatattgccatgctgtaataaatactccttttggttttaatttttttaaaggtgttgacctttgctacttttagtttttcgcaagaaaaacgctggtgttgactttgtggccccgccaggcccacacgttgcgaagcaatgtataagtgggcattgtatttattttttattcagcttacgccgaatcaaaaaaaaatggtcaagtttttctctggatctaagcgccgaaagaagaggcgcgtaagcttggggtaaagggatataaatcgaagaagggatgtttccttgttgcttatattaataatataacccggcatttaatttttgtaaaatttgccaaataaaaaagatgtgataattgttttgttaatattaagacaacaatagaggtaaaaatgaataaaataataaatgtcattaacaatgagaatggagatggcgatctgcaaacaaaatggtttctgattgattacagcgaccacaacgaaagtatgcgcatcagattaaaagaagacaccgttaaagacgcttttactgctatccgtagcgagtatgagcctcaattgcaggaagcctgcgagcaaacccgtttcagaaccctgtctgggcgatatggtaatgctgtctcttctctcaaaagaagcatcatgcaggagctgattattatcgtaacggggctttttctgaattattttagtatcgacagtacatatgctaccgccagagaagtcatcaggcagttatttggcctatcggttaagcgagaggtgattttattttcctttgcatcaggtagtaggcgagcagacaggaaaagcgggtggttcagtatgcaaaaacatgaaaaatcaatgttgttcgactgttttaatggtgtgattaattccggacaacaatatgaagtcataaaaatccgcctggacgaccttgttgcagccactaaaagataataaaaaaaagatatatccctttgcttttattgatagctgaatttcttaataaggaagtttatatgaaaattaaaggcttcatatccattggatggttgattgaagcaaacgttatattgccggttcttgatgcaacttttagcacttggtgatgggattcaatattacaggagaatttcaatgaaaagaaaagatttacgtcagttaattgcgtcagcccaacaggaactgaacagattaagtacaaaagaaaaagcactgactcgaaaagaaataacacacagaaaaattgtattaggtggagaggtggcaaagtatctggggcttgatattaatcataatgtgttaattggttttctactaagttttgccagctcgacagaagtacaacgaaaaacatggttaagtaacggggtcagagccagagaaaatgaaagtctgagaaaagagcaaagaaataaaaattacatcaaaaaaaatgctcatgaaaaagatgatattaaggtatatcatgaatcggaaaatgttattcagcctgatacaatgataaaaaatactgtaaagggaaaggcaatgcagcttaataacactttttctgcaatgcttgaaaagaaattggcagaggagaaaaataaaaatgaatgaacttatactggaagttatagaaagtagcgatgaggttatcgcggctgcaacagatcatatggctttttttctgttctcaattctctctgattgttatccggaaatcgccacaaatgaatttgagaatatcttcaatgatgagtttaagtttgatattgaaaattttattaaaaattacaggagaaacattggaagcagaattacgatggcgggtaaagatatcgctcaggtttattctaatcagagattttttgaaaaactatcaagagcacttgaacaatgtaaaaaagataagggagctttaactaccagaaatcaggtacatactgttaagttttagcctttgatataacgctgagcagactaaaacttgttttgggctgtgaagggttggacaaacccaccgggtgcggcagtaacttatattgtattttgcattgaagaggagtatataattcctattgcgggagtaatgtaaattattttttacttcactgtttagtaccttttttcaaaagttccttttaattggatgatctaataatcggttttaacatatgctaagggtaaataaatggaaataattggccctcgacaaagcctttcattttcttttagcacatagcggagcatgaatagcgatttttatctgtatgatttactgaatgtaataagtactaatcgtattctgctacccaatcgtccagcttatctgcccattcctgcatcatcgcttttcgttcatcgatgtaagttgcatgattgtacgtgcggcgaacattgtttgtatcagcgtgcgctaactgagcttcgatagcatcagctcgatagcccatctcgtttaaacgtgtactacccgtagttctggtggcatgagggctgtaagttccactccaactgaggcttttgagtagctgacgcagagagtgcgatgtcattgggcctagcgggttatccctgcccggaaaaatatgctgtcggcgcccggttaatccttgtagtgttttgagcatgttgacggcttgggagggaaggggaataacatgttccctgcgagctttcatgcgcgttgccggaatgatccatagtgcgttgttaagatcgaattcttcccattctgcctcggtgacttcggctggtcgcgccaatgtccaccacattagccacatgcaatagttaacctgatatgagccgcgactgttatcaaaacagcttaatagcttaccgatttgactcgtattcaatgcttgtttgtgctgggtcttattcgcaggaagcgccttgcgcacagaccagacaggatcactatcagctctaagcgttgccactgctaactcgaaaaccgatgatatggtacgtcgggcttctgcggcaacagttggtgcgccgcgtttagcagtttcctgaagaattttaagaatgtggtgtgagttgatttctctgacaggaagcttaccgattgagggaaataccacacgttcaagcatatccagtcggcgagttttagttatttcagcccagtctttcatctgtaaccattctttggcgattagctcaaatgtgtttaaagcatcattgaccttgcggatcttatctaactgacgagcctgtgccgggttgattccatctgcaacttgctttctcgcttgctcgcatttcactcgtgcttcggcgagctttactgctggatactcacccaacgcaaacatgcttgatttaccgttgagtttaaatcgataacgccatgcttttttgccgctgggtttcacttccaggtagagaccgttgaagtcgttgagtcgatagagtttttctttcggcctggcagtgcggcattgcgtatcagtgagcatagcggatccatgtctatttactagcttatcattgtactcacctaaaatgataatggaaacgaattgtactcatctatgtactcattttagaatgcgctttcatggaataacatgggacaatctggaatgaaaaatccacgcaatggcgtggattttaaggggttaggtggttttcatggggtgttatgacacctcatgagacaacaaaacttatttagacgttaaacaaaaagttcatcacgtcgccatctttaacaatgtactctttcccttctgagcgcatttttccagcttctttcgcaccttgctcgcccttataggcaataaagtcttcaaacgcgatagtctgcgcgcggataaagcctttctcgaagtcggtgtggattttaccggccgcctgcggcgcggtggcaccgacagggatggtccatgcgcgaacttctttcacgccagcggtgaaataggtttgcaggttcagcagggaataaccggcgcgaatcacgcggttcagacctggctcttcaatgcccagctcggccataaactcatcgcgatcttcatcttccagctcggcgatgtcggactcaacggcggcacaaaccggcacgaccaccgagccttctttctcggcgatttcgcgcactttatccaggtacgggttgttctcaaaaccgtcttcgttgacgttggcgatatacatggtcggcttcagcgtcaggaagctcaggtagcgcagggcggctttatcttcttctgtcaaatccagcgcacgcagcatgccagcgttttctaaatgcggcaggcatttttccagtgcggcctgttcagccttggcgtctttgtcgccgcctttggcttttttctgtacgcgctgtaaagcacgttcacaggtatccagatctgccagcgccagctcggtattgatggtctcaatatcatccgccggatcgaccttattatttacgtgaataatattgtcgttctcaaagcagcgcaccacgtgaccaatcgcttcggtctcacggatgttggtcaggaactggttgcccaggccttcacctttggatgcgcctttcaccagaccggcaatatcaacgaattccatggtggtcggtacgacacgctgcggcttaacgatctcagacagctgatccagacgcaggtctggcatagggacgacgccagtgttgggttcaattgtgcagaaggggaagttagccgcttcaatacccgctttcgtcagcgcgttgaaaagagtggatttaccgacatttggcaggcccacgataccgcatttgaatcccatggtttagtaccctttatagctggatgggcagagccattaggcaggctccaccggaaacgtaagataattttcgcgcattatacacagattcgcgacaatctgggcgattagacaggcttaaaggcatgcaggcggttcatcgccttgatgcgatcttcttttagccacagttcggtgcagcgcgcggcctcatcaatggcatcatcaatcagtttttgctcgctggccgggggcttgcccaacacaaaaccggtcactttatttcgatcgccaggatggccgatgccaatgcgcaggcgatgaaagttattgttgttgccgagcttgctgatgatgtctttcaggccgttgtgaccgccatgaccgccgccttgtttgaattttgcaatgcccggtggcagatcgagttcatcatgggccactaaaatttcctcgggcgcaatgcgatagaaggtcgccatggccgccacggctttgccactcaggttcataaaggtggtcgggaccagcaagcgcacgtcttcaccggctaaagccagtcgtgcagtgtagccataaaatttggcttcttcttttaacgactgattgtgacgctcagccagcaaatccagataccaggcacccgcgttgtggcgcgtggcggcatattcagcgccgggattcgccaggcccacaatcagttttatgctgctcacaaggaatatcctgctgttataaccaaagggcgatagtttactgtgccgggacgcggatcacaaagactgtgccagagaatttattagtgtcagtgattaattatttttcatctaaatcaataagctggaataacgtgttggtcacaaatcatctggtctttatgtgattaagttcacaaattagcctgacggcattgcctacactatcagcagtttaacattgtgtgcgctcatccgaccgcacacacaggaggtgaaagatgaaacgtcatcactcacgcatggcaggtaatgccctgatggtcataggtttaatgaccatgattctcggcgtcggtttttcgattgttaaccaactgccgtcgcttaatctgccgcagatactggctcaaagtgcaatgttcggcattttctttggcgcgctactgtggctggtgggtgcctgtatcagcggtcgtgaaaaagtcgaagatcgctattactgggtccgtcattacggcgataaacgctgccgccgaacccatcattcgtcacattagattttctgacataacccgataaggttctgttcggtttctgcctttggctttggcgcggtaaagtgctttatccgccagagccatcagctcgccaaaatcaatataacgctcatcggcggtggcaaaaccaatactgaccgaatagtcgatctgacccggacgcgaaagctgaacggtatggcgcaccgcttcgcaccagtctctggccggctcaaaaggtaagggcagcagcgcggcaaactcctcaccgcccagtcgggcaaagtgaccctcctgtggcaacatccctgaaaccctgtgacaaaaatcaattaatacctgatccccttgctgatgcccgtagcgatcattaatccctttgaaatgatcaagatcgaataagacgaccgttagtgccttattttgtttcaggcactgccgggtcatattatccgcgccggaaaacagcgcacggcgattccagatattggtcagcggatcgtgaagtgaggcattttttaatgcattacgcgtgcgttcattcaccatcgccagaatggttacggtgaagccaatcacaaagagcatcgattcgacaatcacatagaccgaaaaatcagaaccgctgatcgccccctgtaatccaatcggacgggcgttatccagaaataagcgggcgacatgaaaaatcagatgggtccagagcaataattgtgcaggccagaaggtggcatccatatcgcggcgtgccagccagagtaagtaaatgaatgtagcggtgtaagcgatacagagcaggcagagcaccagaacacgcagggataagctgtcatagaaggccgggatcaggcagagcagtgaccataaggctgctccagccaggccagccatccccggtgatttaccgcaaaatgtccgaaaggcgctgagtaatccgccgtaagccagcatgaccagcacattgctcacggccaccggcaagaaatggtatccctgactgcgcaggctgctaaggaaaaaggcgatcagcgtcagcacgatggcggcacagacatagcccagaatacggtcatagtgtgaaccgacccaggcaaagaccataatcagactcataaaccccagtacgtagagttcgcaaataaataacgtaaagacgtcgaggttcatagtggacggagatcgcaataaaaagtgcgggcaaattaccactcaacgtaaaaaggcaaaaggccagataacataattttagcgaaagagtttttcgtagtgagcgtgacaataacagaggtgactcataacgaaaatttctgtcaatcaagcagctttgtcggaggggaacggcgagggaaaaagaaaaggccgggcatgatgcccggcctgcgaagattaatgttcgaacattgccgaaatggactcttcgttactgatgcggcgaatggcttcggccagcatacctgacagagtcagggtacgtacgtttggcagcgacttcatctcttcagataacggaatggtgtcacacacgataacctgatcgatcacagatttacgcaggttttccaccgcattgccggagaagataggatgcgtagcgtaagcgaagacgcgcttggcaccgcgctcttttaacgcttccgcggctttgcacagtgtgccgccggtgtcgatcatgtcgtcgaccagcacacagtcacggccagcaacgtcaccaatgatatgcatcacctgggaaacgttcgcccgtgggcgacgcttatcaataatcgccatatcggtgtcgttgagcagtttggcaatggcgcgggcgcgcaccacgccgccaatgtccggagacacaacaatcgggttttccagaccgatctgtaacatatcttccagcagaatcgggctgccgaatacgttatcaaccgggacgtcgaagaagccctggatttgctccgcgtgcaggtcaaccgtcagaacacggtcaacgccaacgctggaaaggaagtcagccaccactttggccgtgataggtacacgggcagaacgcacgcggcggtcctgacgggcatagccaaagtaggggataacagcggtaatacgaccagctgaagcacgacgcagcgcgtcgaccatcacgaccagttccatcaaattatcattggtgggagcacaggtggactggatgatgaaaatatcaccaccgcgtacattttcattaatctgtacgcttacttcgccatcactgaaacgaccaacggcggcgtctcccaggctggtgtaaaggcggttggcaatacgttgtgctagttccggggtggcgttaccagcaaaaagcttcatatcaggcacgagaagaacctcaggctttgcgtccagagaatgaacgtcatgacagtaaccggcgaatactgtcgtgaacgttcacacgggtatgtgagtgcgaaacgtgctgtgtctggaacggggtgacacagtcacgctatcgctaatcgccttgcagagtgcgctgtaacggcgagacgttaaggcctcgggctacaaaaccgcgcacccatggtggggcaagctccagcacctggcgagcagcatgctcggtgtcgaattcagcaaacacacaagcacctgtacccgtcaggcgcgacggcgcgtattctagcagccatgaaacaagctcatcaacctcacgaaaacgttttcttactactgattcgcaatcattgatgaacggagcctgtaaaagtgccgataaagtgcgcacgggcgtgtcacgggtgagcgccgggtcattaaagaccagcggtgttgccacgctaacgcctggatgtgcaacaagataccatttttccgcaggcaatgctggagaaagcacctcaccgacgccttcggcaaaggcggcatagcctttcacaaaaaccggcacgtcggcacccagtttcacgcccatttgcgccagcgcctcgggtgaaaaacccgtttgccacaggtggttcagcgccaccagtacggtagcggcgttggatgagccgccgccgagcccgccgcccatggggagacgcttttcaatggcaatacgcgcaccggcccgggcaggcaggctgccgttttcgcgcgccgccgccttgagcatttcggccgcacgcacaatcaaattctgtgcatccggcacgcccggcaccggcgtcagcagcctgatgtcgtcgctctggtcgggcgtgatgtccaggctgtcgccataatccagaaactgaaacagggtttgcagattatggtaaccatctggccgacgcccggtgatgtacaaaaaaagattcagttttgccggagcaggccaggtggtgatcatttcagcgtccagttatccatgcgtaatttaatacgttgatcgccttcttttaattccaggctggcgggcagcggtgggttgaccttgttgtcatagtcagcaatggtcacctgccagttctggccgtcatgcttatagttcagactgcgcagctgatactgctcgttgagctgataatcggtcgcatcgcccggcaggcccatcatccactggcgcaggttggtcagcgggatatccataccggtcagctgcgagatcatcttctgcgcatcgttgctgacataacgtttgcctttgttgtccacaatctgcaccaccgaaccctgagcatccagctgaagctcggtgctgcctaatgggttcgttaacagcaggcgatagcgatcggctgcggtctgctgccagttaaagcgggcataaactttctgtttatccgacagataggcgaacgcgccgcgcgtctgatactgcgtaacgtggctgacggcttgctgatgctgttgccactgtggcgcggtgacgcttgggccagggccttgtggtttattgatgctacaggcagccagcagaacgctggcaaggggtaaaaggcgcaacaggttgcgtgtagaagtcagcatcaagtggtcatctcctcggacacatttttaattgataacaggtaacgctaaccatccgcgttttaaccgtcaatgctgttatacggcaaaaacgctatgatcggcttaatcttattacagtcatagcctttgtatggcttttcttgatctgctgcatcttgtagaatgcgcttcacaaaaacctgacatttattgggacaacccaactaaaacgctatgacgctgctcgcactcggaatcaatcacaaaactgcacccattgctctgcgcgaacgcgttgcgttcgggccggagtcgctggagcaggccttaaacagcctgttatctcagcctatggtgcagagtggcgtcgtgctctccacctgtaaccgaaccgagctgtacctgagtgtagagcaacaggtcgatctccaggagcgtctggtgcgctggctgtgcgaatatcatcagcttgatgaagcggatgtgcgtaacagcctgtactggcatcaggataatgaggcggtgagccacctgatgcgcgttgccagcgggctggactccctggtgttaggtgagcctcagattctgggccaggtgaaaaaagcctttgccgactctcagcgcggccatgcgcttagcagcgagctggaacgcatgttccagaaaacgttctccgttgccaaacgcgtccgtaccgaaacggatattggcgcgaacgccgtgtctgtagcttttgccgcctgtacgctggcgcgtcaaatctttgaatcgctgtccacggtaaacgtattgctggttggcgcgggagaaaccattgagctggtggctcgtcatctgagccagcatcaggtgaaaaagctgatcatcgcgaaccgtacccgtgagcgggcggaagtgctggcgaatgaagtgggcgccgaagtgatcagtctggccgatatcgattcccgtctggccgacgccgatattgtgattacctctacctccagcccgttacctattattggtaaagggatgatggaacgtgcgctgaaagcgcgccgtaatcagccgatgctgctggtcgatattgcggttccacgcgacgtggagccggaagtgggcaagttagccaacgcctatctctacagcgtcgatgacctgcaggccatcattgagcaaaacctcgcccagcgtaaagccgctgcggtgcaggcagaaagcatcgtcgtgcaggaatgcagtgattttatggcatggctgcgttcgcaaggcgcggtcaacaccattcgcgagtatcgctctcaggcagaggatattcgcgcagagctggaaggccgtgcgctacaggcgctgcagcagggtgccgacccgcaaaaagtgatgcaggaactggcccataagctgaccaatcgtttaattcatgcaccaaccaaatctcttcagcaggccgcccgcgacggcgatagcgaacgcctgcagattttacgcgacagcctgggtctcgattaggcacactgctgtcgtcatctgttacgggaatcccacagttaaatgaaaacctctattgttgctaaactggaagcgctgcaggagcgccacgaagaagtggaagcgatgctgggcgatgccggcgtgattgccgatcaggaccgctttcgtgctttgtcgcgtgaatatgctcagttgaccgatgtcacgcgctgtttccgcgagtggcagcagaaccagcaagatatcgaaaccgctaaaatgttgctcgacgatccagagatgcgcgatatggcgcaggaagagctgctggaagcgcgcgaaaaaagcgaattgctggagcaacaactgcagctgttactgctgccgaaagatcccgacgatgagcgcgactgctttgtggaagtgcgcgccggtaccggcggcgatgaagcggccatttttgccggtgatttattccgcatgtacagccgttacgccgaagcacgtcgctggcgggtagaaatcgtcagtgccaatgagggcgaacacggcggctacaaagaagtgatcgcccgcgtgatgggcgacggtgcctatggtcggctgaagtttgagtcaggcggacaccgtgttcagcgtgtaccggaaaccgaatcccagggccgtatccacacctccgcctgtacggtggcggtgatgccggaactgccggaagccgagctgccggaaatcaatccgtcggatttaaaaatcgacaccttccgctcctcaggtgccggtggtcagcacgttaacaccaccgactccgcgattcgaattacccacctgccaaccggtatcgtggtggagtgccaggacgaacgttcccagcataaaaacaaagccaaagccttgtccgtactgggcgcacgtattcatgcggctgaaatggcaaaacgtcacgaagtcgaagccagcacgcgccgtaatctgctcggcagcggcgatcgttccgaccgtattcgcacctacaacttcccccagggccgcgtaaccgaccatcgtatcaacctgacgatctaccgtctggacgaaatcatggaaggcaagctggacagtctgattgagcctatcgtgcaggaatatcaggctgaccaactggcagcgttggccggtcaggattaatggatatccgtcactggctcaagcaggcggtcgccaccttatgcgggggcgacagtccgaaacgagacgccgagatcctgctggggtttgtcaccggcaaatcccgcagctggctggtggcctttgatgaaaccctgctcacgggtgcccagttgcaacagctagaggttctgctggcgcgtcgcgcccggggcgaacccattgcccatctggtgggcgaacgggagttctggtcgctgccgctaaaggtgaacgacgccacgctgatcccacggcccgacacggaaatactggtggagcaggcgctggcgcatctgccggcgtcaccttcgcgggtgctggatcttggcaccggaagcggggcgattgccctggcgatcgccagtgaacgtccggattgtgacattatcggcatcgatcgcattcctgcggcggtagaactggcaaaacacaatgccgactatctggccatccctaacgccacttttttacacagccactggtttgcgcagctagcgcctgcccgcttcgacctgatcgtcagtaatcctccctatatcgacgccaacgatcgtcatcttaacgagggcgatgtgcgcttcgaaccgcgcagcgctttggtggcggacgaggcgggcatggcggatttacggctgctaattgagcaggcgatcaactggctgcagcctggcggttggctgctgcttgagcacggctggcaacaggatgaagccgtgcgtcagctgatgcaacagcaccattatctgtccgtggcgacggcgaaggattatggcggtcatccccgggtcacgtttgggcaggcagcctccggtccggcttaagcgcgcgactgaatactgaagaacaacatggatgaacgatgtttgcttactatccgctaattaagaatctgcacctgctgaccgtggcagtcaccatttcactgtttttgctgcgtttttactggcaacgcgtgggctctgccatgctgcaacagcgctgggtgcgcattcttccccatattaatgacacgctgttgctcctgagcggcgcatcgctggtgatgatcacccatttctatccgttttcgcctcagggaagctggctgactgagaagctgttaggcgttattatctatattgcccttgggtcggtggcattaagtcgccgccctcgttctgaccgcacccgctggatcgcctttatcgtggcattgattgcgctggtgacgatcattaagctggcactgagtaaaatgccgttactggggatagtatgagctccaccgaacaacttgattacagtgagacgccgctgtgtgaggcagtgattggtgccacgatggccatccgcactgactttccggcgctgtcggttgaagcacagttagctgctttagtggcagaagcccgtgactacgtcagtcaggaacaggatgccgatttaaagctcgaaaagctgctggagctgttttacaaacagtggaaatttggcggtgccagcggggtttataacctgtcagatgcactctggctggataaggtcctgaaaacccgtcagggcacggctgtgtcgctgggcgtgattttgctgcatatcgcggctgaactcgaattgcccctgatgccggttattttcccgacccagttgattctgcgtgccgactggctcgacggggataaatggctgattaatccctttaacggggacacgctggacacgcacacgctggaagtgtggctaaaaggcaatatcagtccgctggcgcgtctgtatgatgacgatctggacgaagccaaaaccgagagcgtcatgcgcaagatgctggatacgctgaaagcggcgctgatggaagagaagcagatggaactggcgctaaacgtcagccaggtgttactgcggattgatccagatgatccctatgagattcgcgaccgtggtttaatttacgctcagcttgagtgcgagcatatcgcgttaaatgacttaacctacttcgttgaacagtgtcctgaagacccggtcagcgagatgatcaaagttcagattcacgcaatcgaacaaaaacgcgtgacgctgcattaagcgtcaccccagataaggaaagggcatgacacagaaagtcgtcagtatcggtgatatcaaggtcgcaaacgatctgccatttgttctcttcggcggcatgaacgtgctggaatcctacgatctcgccatgcgcatctgcgagcactatgtaaaagtgaccgacaaactcggcattccttacgtgttcaaagcgtcttttgacaaagctaaccgttcctctattcactcttaccgtggtcctggcctggaagagggcatgaagattttccaggcgctgaagcaggcgtttggcgtgaaaatcatcacggacgttcatgaagcagcgcaggcgcagcccgttgctgatgtggttgatgtgattcagctgccagccttcctcgcgcgtcagaccgatttggttgaggcgatggcgaaaaccggtgcggtcattaacgtgaagaagccacagtttgtcagcccgagccagatgggcaacatcgtcgataagtttgccgaaggcggaaatgacaaagtgattctgtgcgatcgtggcagtaactttggctatgacaacctggttgtggatatgctgggctttaacgtaatgaagaacgtgactaagaattcgccggtcattttcgacgtaacgcacgcgctgcaaacccgcgatcccttcggtgccgcctccggtggtcgccgtgctcaggtggccgaactggcccgtgccggtatggctgtagggattgccggcttgtttatcgaagcccacccggaaccaaacagtgccaagtgtgatggcccgtcggcgttgccactggataagctggagcctttcctggtgcagatgaaagccattgatgatttggtcaagagcttcccggcgctggataccagtaactaagctgtctgcacaaaataaaaaagagcgagaattcgctcttttttttcgtctcaggtcagcaggttacagcatgattgtcatcaggtagccgataaacagggccagatgggccgcgccgttcaggacattggttcggccagtcgagaagctgagctgacacagaatcagtgacgcaatcataatcaccatctgcggtggctccaggccaaacaccaactcttgtccggtcagggttgcgatgatcgagacggcaggcacggtgagtgaaatggtcgccagcaccgagccaaagaacaggttcatggcgcgctggacctggttcatcaacacggctctgatcgcccccagaccttctggcgacagaattaataacgccaccagaaagccggtaaactgcttaggcgcattcatctcgctcagtaaatgctccagcgggttggcattcatcttggtcacggcaatgaccgcaatcagatggataatcaaccagatagcgtgccagacgctgctgtgggcagagggtttaccgtgatggggatcgccatcatcgctttcatcttcatgctcatacacaaacaggctctgatgggttttggtctggattaacaagaaaacgccatacattgcagcggagatcgcggcaatcagcagtgcctgggccgtcgtgaagttcccaccgggtaacgcattcgggaacaccagcaccaggatggccagcggaaaaatggcaatcaggtactgttttaccccggccagattcacgtactgcgtagcaaacttattcccgcccagcagtagcgcaaagccgaccagaccaccggtcacgatcatgatgatggaataaagtgtatcgcgcatcagggcgggcgcggcatcaccggttgccatcagcgccgagattaagctgacttcaagaatgaccaccgacaggctgagaatcagcgagccatagggttcaccgagacgatgcgccagaacatccgcatggcgcaccacgctgaaggcgctgctaagaatcgccaccagcgcgagtaagttaataccaaccacgatgggcagtgaggtttgtgcattaaaaaaatagagtatgccaagggcaataaggggaagtatcagtgaaaactctttgtgacgtgttttttcatgtgaaggcattcaccatcctctctgctgaataaaaggggtaattcatttacccaccattacattgaaacttataggttacgcagtttaacttttcaatcgcacctaatgtaaaaatttaccgctttttacttttaaagggattttgcctgaaaggcggataactttatcttattggggattttattcactaaatcagtaacaagcattaagcggctgcggcattatcctggattttatcaagataaaagttcagggaaggttgtcgttaagctgccattgaaggcgaaacccgtaaaggcggtaataagtgcgggtttgcattttcactcatctacgccaggcttattaactcgcttgttaactgaggagacatgatgccttacgctaaccgaaacgaccttcccgagagtgtgaaaaacgttttgcctgcacatgctcaggacatctatcagcaggcttttaaccacgcctggacagagtacaagcatcccgatgaccgtcgcggtgatgaatcccgtgaagaggtggcgcacaaggtggcctggtcggcggtaaaacatcaataccagaaaggcgatgatgataaatggcatcctaaaaagtagtgccctgcgccatcatcacgcaaacgtcaggtcactccgcgtcgtcctgtagcctgtcccatggacgggaaggcatttttctgtctcggtgcgtgcaggtatttacggctttatttcacgccgaaacggtcattaaacgcaacaaccttcctcgttaatctggctatatacggtcattagcgggtaaccctttttacgttatttttcatccgctaagccattcagacggcgcgcaagcaacctgtaataacgggctgttacatctcctgtttttttaaaatatccttttggtgtgcaattaacctttctgttaataccgcaatataggcaaatttttactttctactccgactcttgcttgcaactgattgtgttaataattaatgtcagtttaatgaacagagcgtaaattagtgaatgttgaacataacaaagcagaggagccacttacacaggacgtggtgaaagtcgaggaggtcgcattgctaacccgggaattcttattaaaagcggattgtaaaacatcatttggtgatattgaggagacactcctgtggagttgtgaacagcgcgcggcatcgctggcggcaaccctggcctgtcggcccgatcacagcccggtatggatcttcggctacggttctctgatgtggaacccggtttttgaagctgatgaggttgcgtcggcgtcgctggacggctggcatcgcgccttttgcttacgcctgactgccgggcgcggcacggcttcgcatccgggacgtatgctggcgttgaaagagggcggtattacccgcgggctggcgtttcgcctgccggaagaacgtctgcatgacgaactggaactgctgtggaaacgtgaaatgatcaccgggtgctatttgcctacctggtgtgagctgacgctggaagacggacgtcgtgtttctgccctggtgtttattatggacccccgccatccgctgtatgaggatgatacctgtccgcaggcggttgcgccgttaattgctgcggcgaccgggccgctgggttcgaatgcccagtatctcttctcgctggaagaagagctgaccaaacgcggaatggaagaggacgatctgatccgcctggcgcaccaggtacgtgcgctgcaacaagactggctgaagcaggcctgaaccacgcacccatccaggcaggtagcctgcagggctgcccagcgcaggctggcaccgaattaattggtgggattaatcagccaggtgccgggtttatcaatcagaagtgactgactgcgaagccggttcccggcccgcacgtcaatacggtactgcccggcggccagattcaacaccgcaaaaccgttgctgctggcatgcaccgcaacgggctgaccgttcagcaccacctgttcgtcgctggtgagcttaagatagaccatcgccagaccggcgggtaccgtgccggtagccggtaacgcatggctcttatcaacgagcgaagcagcaggcgtacgcgtattctcaatccagactactaccgccaccgcaatcatcgcgacgccagccagcgccagtaatcccggcgacaggcgacgtacgttgcgtccggttaacggctcggccatcgtggcaccgtgattcatggctaacacgaccggcggcacggtctcggctgacgcggcgtcactgatagactgctcatcattacgctgttgcaggctgttcaccaccgcctcaacgtcgctgacgggcaaatcaatcagcgcggcaaactcatcaatgttctgcgggcgagcgtggggcttcatcgtcagcgcgcagtcaatcgcgtgcagcagcggcagcgagtagccctgcggtttacgtgccaccagcggttggtaattatcttcaatgcagcgcaccacgctgaccggcggcggagagcctgtaatcaacgtatgtaacacggcacccagcgcataaatgtccgtccacggcccctgttcactttcgccttcttcactgtactgctcaatgggcgcaaaacccggtttgagcatgatttcagtttcgtcggaaagattgccaatctctttacgggcggagccaaagtcgagcagcaccggcagctgattttcctgaatctggatgttatccagcgagatatcccgatgcaggtagcccgcctgatgaatggtgttgatagcgcctaacagcggcggcagcaggcgacgtatccaggcttctgaaatcgcctcatggctggtgacctgccactcttttaacgtcatgccgttgtagtagagcgtgcccatgtaggcagtgccgttctgttcccagaagcgcaggacgtgaagtaaaccaggatggttaaaacgcgccaacagtcgggcttcctgaataaagctgttcaggcccgcgttaaacagcttttgaaaccgttcaccgcgcagcgccagtgataagtcttcggttcttaccgccagcgacaccggcatgtactctttaatcgcaatcgtgcgttcgagttggtgatcccatgcgcggtagacaatgccgaaaccgccgccgccaatcacctctttaatttcgaactcgttaaaacgatatccgtcaggcaaggcattcggtattgttttctgactgtcatttgccgacataatagactctctgaacggggcctgcttgtcaggctacgcggtaattaatggatgttacgccatgcaccttcagcaggatcgacccgatccgcgcgtaaggcgtcgacaagtaacacattcactttttgcgacgatgtcataccggtcgcccatcggctgcgcagggcagtaatgcgcgaggtcagcgcgctggcattctgctgtgccgccgttttatcggctttgatcaataaggttccgtcaaaacgccacagatgctgctgtacatcaaagggcaagaccatccagctgtctggcgcatcggaacgggccagaatcatgcgctggttattaacgtccacaatttgcagatgctggtcggatagcgtcaggttggcaatgggatagccctgataaaagctgatcgcaagcatctgtggttgcgcgccaccgctcagggttatgtcacttttaccttccagccagccctcggcggagcactgctgtttaccgatgtcgggcacaaacatagccagcccacgcgcgtcccaggccgtgcgaaaacggcagccgtttggtaaggcgaaatgctgcagcggcgtgccgtctgccggacgcgacaggctgggcgagaccgcactctgtgcaggggcagtggctttggcatcggtattcacaatcagtcgccagttttgcaatttgctggcgctgccgctggccagcacgttgccctcgctattggtcatttgccagggcagcacgtccagatcgttacactgattggctaacagcgtgcccacgcgcggcaaaaacgtttttaaaacctcagcatcctgacctttacccgacacaatacgcagcggcagtgtttcctggcaccactcatccggcgttttgcccgcaacgttgtcgatatacacttccagttcaagactgggtgaatacaccacgcgataattttccgcctgcgcagtaaaggccataaacaacgtggctatagcgggcaaccacaatttcatagaattcctttaatcaataacctgatggcagaaaacgcgcggaatcggccagcgtatagagcagggtggcatcttgcggctcaccaatccatacggccagtgcgctaaggttgtctttctttacgtcgcggctcaccgcctgttccattaacatcagccactcgtcacaggcatttaccatgcgcagcgcctgctccatttccgtggtggtcaggttgagccagaaaccgtcgctacagactaaaaacgcatcgccatcttccagcatgatttcgtcagagaagctcaccggatgggcaggttctatgccgagcgcattatagagtaaattactgttaattccggtattttcatagcccgcatcgcttaacttttgcgccagactgtggtcacgcgtgacctcattcagcaccccgtgacggaagtgataaaccctgctgtcacccgcgtgcgcccaccatgcgcgctgtcgcgtacggtcaataaacaggcctgccagcgtggtgcacatggtggaaaaattcggattattaccctgggctatttcaagtaaagatcggcacttttcaaccgcctgccgggtaagggctggcgtcacctggtcgcaggtgagtaattgttcaatcaggacatcgcacaccagctgcgccgcctggtcgccgccgggcaagccagccacgccgtcgcacaccacaaagcaggctttgcgttcatccactatgacgccggttcgatcctgattctcagcgcgcagcccctgctgatactgactggcaaaggcaatgttcatgcgtcatccgtgcgcgtctgtgagtctttgtactgattcacttccatgtcataggcatgaagaaaggcttccccaaacagcgtgtgaaaatcgtcttcgatttccccggcggtacgctggtagcggcgagtaaaatagtcccacagggcagcttttttaaagggggaaaagggggttttcgacaccgcgccgtccgcgcgtgcctgttcttccagcccctgaggattgaacgactgcagcatcgcggcgataatcgcgcggattccggcaatcatgcccaactgatgcgcctgcagatcgaccaacgcatcgcgcacggcctgttcgggctgcataaaacccggcatctggctttgatacatctgcatcaagacggttttgcctgaggggagaattttgaagggattgttggcctcgttcaggatcatcgtcatttcggctttgacgccacgtttcagaatggaacgcgacgacagcagggcaaccgtaccttgagagaacaggcttagcatccggcctgtggtgcgcatttgctcttcgctgatcaccgtattgtggccgtttttcagccccattccgtccagcagcgccgccaccagcttgtcctgatccagcccggcggcaaagggcgcatgaaaagtttcgctaatctggggatcgatcgccagcctggcgtcgccgcgacgttcaggacgcttcggtacaggctcttccgtgacttcctccacctccgcatgctcgggaatatccagcggattgctacgcgtggcggcatgggaaaaaaacgccagaggatcgctgttcacgccgtgatacgccggatcgcgcacgtcaatggcgtagtcaccaatgcgcagggcgtcaccgtgcttgaggtgcacctgcatgccgcgcttaagcggcacaccgttgtgttcgacaggcgtaacgttgccctgattggtcaaacggcattcgccttcgcctgacaggtgcaccagcgcctgcagacgcgaaatagaacgggcttcatccggtaacaccaggtcgttatcctggctgcggccaatggtgccgcccggcggatgaaaggtgacggttttcaccggaatatcagacgtgcattgtacgatggtaaattgcatgagttatcccgtcatggaggacagtagcaacgcctcactcaaacatcggtggatagaggccattgcgtcccggctgtgcacctgccgccggattaaacagtaatgagaacagttccgctgtgaggttgccgctatgcttgtgtgtggcatgaacgaaaccgtcactgcgattgctccaccagtaactaatgtgttgctgagggtcgaaacgttcggcgacttcctgccagctcagggtgcaaggcaaatcgtggaaaccgattacatccataatatcggagtgctgctgtaccgggatcatcagcggcgtcagcgcctgaatctgctgctccagctgggccggcgtaaggcgctgcgtcacggcgctcagtagcgtggcacccagttcctgaaaccagtcgccagagatggtcagctgcgccggatgccactgggccaggggaaagctcagcagcgccagaagcggccaggcgcgtcctacccgatcgcaggagggcagcagacaacccatctgcacctgattgcgggttggggtgatcggtaatacgaaattccataccggggcgcgtaaaaagtcggcattcaccgcaccgtcctggtgatgccagtgcaccaggccttgctgaaaccagtggttccagggggcaataagctgctcggttaaccgatgatgcaaaaagtcccccgtcgagggcaatttgccgtaccagccaggggccagagatgcaggcatgttcacctcgccattatgggttatgcgtcgtcaggcgctgtgctttacggggcgcgacggccagcagggtattgctgtcacctgcatggtttaaattatcagccagcttgcccaacatcagcgcgttatcgcgcgcataaggcgaagactgaatttgctgatccagcaactgactcaaatgccagtccagctgctgcaaatcacgggcgctgaccttgtccggtaacgaacgctgcagattctgcagcagccaggcgcggagaaattccccatcataatttcgtggctggtacagcatctgataggcccgcagcgcgttacggctgtattcgttatcatcacctgggtcgttacgcagcaggttggtgatctgctgggcaacgcgcggcagtaataaagacttaagcgcattttgataaagcgcccaggccgcatcgctgacctgatttccccggtataaccccgcacgcatagtaaacggcggattatcgagagaaaactgatcggacacaggcaacttcaccaggttattcagaaagggtagcagatcaaaaatattatcagcaggctgatgtatcacctgctgactttgttgtgagataaccggcattcgcgccgaaacctgctgcagataatgttggttttgatagtagctcaccaaccataacccactcatgatcaccagcgcaccggccagcatgccgtagccaatccagtgtaaaagctgattacggtattcccagcggcggttgctgcccgccaggccgctctctttaaacaccagattactcagcagatcgcgaataaaaaagctctggcctttattaccgggaatggggctgttgcgattaacgcgatcccaggcggcaatagaatgggaaccggcctggcgcagctgcagtttgcggctcaactcgcccatgacacggtcaaaaggtaatccttcctgggtgccgctggtaaaaaacaggccgcgcggattccaggcaacggtgtcagcacgctgagaaaacacgatatccagatattcgctgagcagcgggcgcagagacgagaactcctgcggaaacaggaaacactctgcccgctcattcagatcgcgctcgtgggtcatctgatcggccagctgcaactgcagcttctgggctaactgcgtaaactgcaggtcaaaatgcgggtgccagtcctgcttattcggcttgccggcgtcccaggggaaggtgaacccccagatagcatcgcgtcgggctttatccagcgtgccgtagtagctcatgaagcctttcagcaggtcggttttggtcagcatgatatacacggggaagtgaatgccggtgtgctgatgcagttcggtcaggcgttcgcgcagggcgttggcctgctcaaaacgcgcctcggcggaatcgctcagcaaatccgccacgctgatggtcatgatgacgccattaatcggctgccgggcacgatagcgcttcagcaaattaataaagctctgccactcgctggcgtcgcgggcgcgctggctttcctgaagcgcatagcgcccggcggtatcgatcagtacggcactgtcggtaaaccaccagtcgcaatgacgtgtgccgccgacgccgcgcaccgcctcgtgaccaaaggtatcggtaagagggaacttcagtccggcattcagcagcgcggtggttttaccggcaccgggcgcgccaatcatcaggtaccagggcaactggtagagatagttggcattgatgcgtgcccacaggctgccctgacggcgaccaaaatgggtgcgtttcaggcgcatggccgcgtcgctgaaacgctggctcagcagcgcttcagtcgcctgacgctcggcgggatcgtcgctttctacgacctgcagccgatccagaagacggctgttataccatgcacggtaaaccgcagggatcagctgaagcacgatccaaagcagataaaggatgctcaccgcgatctcgcggtgcagggcaggctcaagcgggcgggtttcatcccatgcaataagcggccccagcatccacaacaggcaactcagtgccgtgacgccgataaagctccacagcagccgatgcgttaaaaataagcgaaatgaagcgcgcatcagtgtgttccttggtgagtgctcagtgtttcaggtgcggcaaacagcgtgatttcaacccgtcggttacgggttcggttttcgctgctgtcgttgggcagcaggggatcgctgtcaccgcgtccttccgagcggatcacatgcgcatcggcaagctgaacctgcagcagctggctgacggcacgcgcccgggcaaaagaaaattcatagctggaggcaaaacggctgccgtccacgggtttatcatcggtaaacaccgacaccagaatcgtgcccttaacatctttcatcgcgctggagacccgcgccagaatggcccggcccaccggattgatcaccgtgccttgctcggcaaacagcttgtccgcgggaataatgactttactgccaaaggcaccgtcactgacttccagttggccggcggcgatcacatcattgagccgctggcgcaaatcgagcagggcctggggcgaagaagggcggcgatttaccgtaatctgcggcaacggcatgttatacaggctgcgcagcagcggctcggccgcattgcccagccgccagtttagcccgctgtaaatcaggcagccaatcagggcgacgagcattgcacaggcccagagcggcaccatcggacgtgcaagcgtgctgaccagcggatgcacctgcaccagcggaggggaatcggtgctctgctgggcgcgggtttcatcgatcaggacttttaaccgtgcccgcaggctgtcgcactgtgcccggcctttttcactgccccggtagcgaccttcgtaacctaataacaggcagtaatgaatgatttccagcagccagagatgctgctgcgggctttgcgagatacgggacagcagctgaaagaatttttcaccaccccagctttcattgtgaaacgtaaccagcatgccgtttccggaccagacgccgcgcgtgccccagggcgtttgcgcggcggcctcatccagagcgctgcagatgcagtaacgcgcaccaatgatcatttcaaacggcaggcccgcctgcttacagcgttgctcaaatacgcgcacctcatccatcagcgactgacgtaaacccgcggggtcgtcatgagtggcggcctgacgaatttgcaccaccgcattcagcagtggcgcggcagcgttaagtaaaagattttcggtacccgaggtcgtaacctctcgcggtgatgattccacgctcattactgtgtgtttttcccgcgacaggtagcgtttctggcagagtgcccagcacggcaggtgttaaatttcattagttcagaatccaggtcgccgtcgcggtattacggcaggctttgctgtcgcccccgacgtcaacgcacacttgtttcgttttccgcggacgcggacggtcattgcgtaaggtgtcatcgtaacgatgcgtttccacgcccgcctttaacggcacgtaaccggttaacatcccgtccggtttatcggcaatggccagccagtggttctcgacgctgccgaggacctcaaaaggttttccagcctcaagataacggacgaccttgccgccgtagtcgggttgggtcatcaccgacgcgttatacagggcgcgccaggtttgattgacgggcgtaaaggttgtcggggcagctaccgcatggcggtgtaccagcttcacgccttgaatatcactggtgaccagcgtgtcatcattcaccgagggcggtggcgttttgcagccggacaataacagtcccactgacaggataaacgctaaattatttttcaccattttcctcacgatattatcaatatacctgcatgttgttcatcagaacacgaccgttcaccttcacgggggaagcgcagacgggtaggcaagccggtaagataaacgggcaaatgacattcatcctgtaccgcgctcagtctacctaagacttttgagaattcaaaccattgcacccaatgatatagcatggtaatgcgcgttcatcatcttcttatcccaccgccctgatgcgccggttccgccgcccctgaaccgcagagaaagcggacgctgtcagggccgcctgacaagccggctgcataatgtcacattcagatgacaggcaaaaaaagagtaagcgttcttaacgacttaatggcacgcaatgcctggccggtgacgaatacggtcattgtttacgcgtcacaatctttagggacggtgaaccggaagcggcatggcttttgctttattctttttttgcattgagagagatgagcaatggatgacgcactgagctggttgcaggcctcacggcaaagcgatatcgccagtctggagcgacttcgccagaccggtaaattaattaccacggtgagtgaattagtccatcagctacagcgcgaacgcggtgccagcaacctgtggatttgctcacaggggcggctgtatggcgaggagcgtgaggcgagtgaacaggatgtcagccgcagtcagcttgccttttgtcaggcattacccagggcggaggcacagccgggatacagccggttctgcaacctgatagctgccgccttgcaggcactggcagaattacccgcgctgcgccagcagatcgctggtctgaagattacccacgcgcaggccatgatggcgtttagccctgttatccgaagtttgctcaatctggtttttgaagccgccgacacatccagccacccggaaattacccgggcactcattgccctgtttagctttatgcagggcaaggagttgaccggacaggagcgggcacagggcgccgccggatttgcggccgggcagtttagtgccgaacagcgcagtacgatggtggcgttaatcgaagcgcaggaacaaaacttcaaaacttttcagcagtttgcggatgaggcggtgcttctcagctggcagcctctggcccagccaggtcgggagatcgaacggctacggcgcatcgcctgcaccgatggcagacgcgacgacagcggtgcactgcactggttctcactgctttcggagcgcctcgatcagatgaagtcgctggaggatcaactctctgccgtgctgatgtcacgctgccgtgacgctatcgccctggcacagcatcaggccggtgaacccttaagtgtggcgcagtcaggctgcaattttaccctctatgtctcaggcgcagactggctggagaaccagcctgctaccctcaacagcgaggggctcgctccccagctcgggcgatcgttactgtcgttgattggtgaacagtcccaacgcctgcagcgtcaggctaacgagctggccgcgatgcgcgccacgctggaagagcgcaagctactcgaccaggctaaaaactggttaatgcagcagcatggcctgagcgaagaaaacgcgtggcaaatgctgcgcaaaagcgcgatggaccagaacaaacgcttaccggaaatcgcccaggcgatcgtaacggttgccgccacggtgaagcgctaacccgaaagtgttagctgcacaacgcttgtgcgtgatctgcgtcactaccgtgcaaaaacggttaaaaaaccatcgcgcaggcccgcacaaggctgttttgaccgcactcatcactctggcacgcggtttgctttaccttaatgagtatgtgtatttgctttgccaacggcggtagagcgagtgctttggataaaggcgtccattcccctgtgagagcagtggggaggacgccttttttttatctcttcagggtggcaaagatgagcaaatcgccagtttcactttctcgtcgtcaactgctgttatccggcgcagccgtcggtggactctggctattgccgggattgcgcaacgcagtgtgggcggcgggttccgatgccccagaaaaaccgaccgtgcgcgtcggctttattcccctcaccgactgtgcgccggtggtgatggcctcggttaaagggtttgacaagaaatatggtctgacgctgcaggccagcaaagaagccagttgggcggcagtgcgcgacaaactcacctcgggtgagctggatgccgcacacgtgctctacagtctgatctatggcctgcaactgggcgttgccggtccccagcatgatatggcgaacctgatgacgttgaacaacaacggtcaggccatctctctgtcgaaccagcttaaagcccagcaggtaaccgacggtgcaagcctgaaaaaggccatcgacggccaggcgaaaggcagcttcaccttcgcccatacctttcccaccagcactcacgccatgtggctctattactggctggccaatgccggaatcaacccctttgacgatgtgcgcaccgtcgtggtgccgccaccgcaaatggtgatgaatatgaagattggcaacatgagcggcttctgtgtcggcgagccgtggaaccaacgcgctatcagcgacaatatcggctttaccgccgccaccagccagcagatttggccggatcaccctgaaaaaatcctgggcacccgcgctgagtgggtcaacgccaacccgaatacggcccgtgcgctcactgccgcggtgctggaggctgcccgctggatcgatgcgtcggacgataaccgccgtgaaacggcccaggtgctggccgggcgggcctggatcaacaccaaacccgaaaccctggaaggacgcatgttgggccagtacgaaaacgggctgggtcaaaaatggcaggacccccacgccatgcgctttttccacgacggcagcgtcagttttccctatctctctgatggcatgtggttcctgactcagctgaagcgctgggggatggtgaacagcgatccggattatctggcggtcgcgaagcagatcaaccgtattgatatctacaaacaggctgccagcgcggtcggcaacgtcacgctgcccggcagcgacatgcgcagcagcaccttaatcgacggcaaagtatgggatggcagcgatccagccgcctacgctgccagcttcgctattaaacgttaagagaggccgtgatgaaaacccagactcgtccactggcgcagccggtaaccgcgcccagccaggcaacggtagttccccttcaggttacgcctaaaaaagtacgaccgcctgcgcgcttacgtccgttgttacagcgcgcgattccggtgctgtgcggcgttctgctcctgcttctggtgtggcagatcgccgcgctgtacagccagggctttcccgggccttacgccacctgggaggcggctaaaattctgttcgccgatcccttttataacaacggccccaacgatcagggcatcggctggaacgtcctggcctcgctgcaacgtgtggctgttggatttggtctggcggcgctggtgggtattcccgctggctttctgctgggtcgcttcacctttgtcgcgcggatgttcaatcccatcatcgccttgctgcgcccggtcagcccgctggcctggttgcctatcggcctgctgctgttccagcgcgcggaaccggcctcaagctggaccatttttatctgttcgatctggccgatgatcatcaacaccgctgaaggcgtgcagcgcatcccgcaggattacctcaacgtggcgcgcgtgctgcagctctccgaatggactgttatgcgccgcatcctgtttcctgccgtgttgcctgccgtgcttaccggcgtgcgcctctccattggcattgcctggctggtgattgttgcggccgagatgctgaccggtggtctggggattggcttctggatctggaacgaatggaacaatctgaacgtggaaaacatcctgattgccattctgctgattggcgtggttggcctgctgcttgagcagggactgatgctgctggcgcgtcgttttagctgggataaataaggagaacaccatgcaacctatcattcgcgtacagcaggtcagccagcgttttaccacctccggcggggatttcctggcgctcgataacgtcagtttcgatatccatcagggggaaacgctgagcctgatcggtcattccggctgcggtaaatcaaccctgctgaacctgattgcgggcttaacccgacccaccagcggcgtgctgctgtgtgataaccgtgaagtgaccggccctggccctgagcgggcggtggtgtttcagaaccactctctgctgccgtggctgacggcgtttcagaacgtggagctggcggtgcagcaggttttcaaaggcaagatgcacaaggcggagatgcatgactggatcgagcacaacctgaaccgggtgcaaatgagccatgccatgcacaagcgccccggtgagatctccggcgggatgaagcagcgcgtcggcatcgcccgcgccctggcaatgaagccgcgcgttttattactcgacgagcctttcggtgcactggatgccttaacgcgcgcgcacctgcaggacagcgtgatgcgtattcagcaggagttgaataccaccatcgtactgattacccacgacgtggatgaagcggtgctgctctctgatcgggttctgatgatgaccaatggcccggccgcccaggttggcgacatccttaaggtcgatctggcgcgaccgcgttcgcgggtggcgctggcagaggatgcgcgttatcaccagctgcgccagaaagtgctgcattttctctacgaaaaacagacgtcggcggcgtaaggattacaccatgagacaacggctgctggtggtcggtaatgggatggcgggcatgcacacggtggaaacgctgttgcagctggcgccgacgcgttatgacattacggtcattggccgtgaaccgcagggtaactataaccgggtgctgttgtcgccgctgctggccggcgaaaaaaccgttgagcaaatcctgattcacggccctgactggtacgcacgccatggcattcgcttactgaccggagaaacggcggagcaggtcgatgtggctgggcgcaccttgcggacccggcagcgcctgctgcactgggatcgtttgattctggcgaccggatcgcagccgcgcatgccgcaggtggcaggtatcgatctgcctcatgtcacggcttttcgcacgctggaggatgtggatgcactgctggctggcagcggtccggtcgtggtagccggtggtggatttctgggcattgaggccgcggcagcgcttcgggcgcagggacgccaggtgacgctggtgcatcgtcagtcgcgtttactggacaggcaactggacgccagggcgggagaattactgctggctcagctcagcgcgcgcggtatccgctgtgagctgaatagcagtatcgccgcaattggcccgcagtccgtgctgcttaacgatgggcgtcaactggcagcgcaacaggtcgttatcgcgattggcgtgcagccagaaaccgcgttggcgcaggcatcgggcattccctgccagcacggcatcctggtggaccggcagttacgcagcgcgcacgctggtatttatgcggtaggcgaatgctgtgaaatcagcggagaaacctttggtctggttgcgccttgtctggcgcaggcagaggtactggcagcgcagctggccggttgtccgcaggccgatttctacagcgaagccaccggcacgcgtctcaaggtcagcggcatttcgctgttcagcgcgggcgatattcgtgaagccccgtcaatcaccagtttcgatccgctttccggacactatcgacgtctttttctgcagcacggacggctgaatggggtgctgttgtatggcgacagccagcagggtgccgcgttgcttaacacactgcataacgccaggcaggtctcaatgaataccttgtttggccttgatgaacctgaaacgcagccgcaggctgcaggaaactccgcgatgaatcactctaaacctgtattagccgtcgtgggccacggcatggtcagtcaccattttctggaacagctggtggcgcgtggtctgcatcagcattatcacattgtggtgtacggtcaagagcgccattcggcctacgatcgggtgcacctttctgaatacttcaccggcaaaaatgccgcgcagctctcgctggtcgctgaggacttttttgcccaacacgacattgaactgcgcagcggttgccgggtcgaggcgatcgatcggcaacagcgcagcctgcgcgacagcgacggcaaagcactgtgctgggacaaactggtgctggcgaccggctcacgggcgtttgtgccgccggtgccagggcacgagggcgagcgctgctttgtttaccgcacgctggacgatctggatgcgatcgcggcctgtgccgacaaaagtcagcgcggtgtggtcatcggcggcggcctgctggggctggaagcggccaacgcgctgaaacagctggggctggaaacccatgtggttgagtttgcgccacgcctgatggcggtgcagctggacgagggcggcgcgctgatgctgcggcagaaaattgacgcgctgggcgtgacagttcacacctcgaagcagaccgaacagattgagacccagcccgacgggagcctggtgctacgctttgccgatggcggtgaactggcgaccgatctggtgctgttctcggcgggcatccggccgcgtgatgagctggcccgtagtgccgggatcggtgttggcccgcgcggtggcattgagatcaatgacgtctgccagaccagcgacgatgacatttatgccatcggcgaatgtgccctgtggaacggacagatttttggtctggtggcgccgggctatcagatggcgcgcgtgctggccgggcatctggcggacgaaccggcccggttcagcggtgccgatatgagcaccaaactgaagctgctgggcgtggatgtcgcctcctttggtgatgcgcacggcaaaacggcaggcagcctgagctaccactgggccgatggtccgaaaggcatttacaagaaaatcgtggtcagtgccgacagcaaactgctgctgggcggggtgctggtcggcgacagcagcgactatgccacgctgctgcaaatgatgttaaacgccatgccgctgccggattccccggaagggttgattctgcctgcgctgaacggcgctccggtcaaagggctgggcgtggccacgctgcccgacagcgcccaggtctgctcctgccacaatgtgagcaaaggcgatatctgtagcgcggtgcagagcggctgtagcgatatggccagcattaaaagctgcacgaaagccgcaacgggctgtgggggttgttcggcattagtgaagcaggtgatggagttccagttggaaaacctgggcgttgaggtgaaaaaagatatctgcgaacacttcgcctattcacgtcaggcgctgtaccacctgatccgcatcaatgaaatcaaaacctttgatgatctgctggcgagccacggacgtggctgtggttgcgagatctgtaaaccgctggttgggtcactgctggcctcgtgctggaatgattatttactgaaaccggcccatctgccgcttcaggataccaacgatcgttacttcgccaatatccagaaagatggcacctattcggtcgtgccgcgcgtaccgggtggtgagatcaccccacaggggttgatcgccattggcgaagtggcggcgcgttacgacctctacaccaaaatcaccggcggtcagcgtatcgacctgtttggcgcacggctggatcagctgcccgacatctgggaaaccctgctggcggcaggttttgaaaccggccatgcctacggtaaatcgctgcgtacggtaaaatcctgcgtgggctccacctggtgtcgctatggcgtgcaggattcgacggccttcgccatcgcgctggagaaccgttataagggcctgcgcgcaccgcataaaatcaagatggccgtctcgggttgtacccgtgaatgtgcggaagcgcagagcaaagacattggggtgatcgccacggaaaagggctggaacctgtatgtttgcggcaatggcggcatgaagccgcgccatgcggagctgtttgccagcgatctggatgatgaaaccctgatccagtatgtcgatcgcattctgatgttctacgtgcggacggcagatcgcttgcagcgcaccagcgtctggatggataacatggaaggcggactggattacctgcgcgatgtggtgatcaacgacagcctcggtatcgcggcgcagctggagcaggagatgcagcaggtcgtggacacctaccagtgtgaatggcagaccacgctggctgaaccctcgcggcgggcgctgtttaccgcgacggtgaacagcgatcatccggatgaaacgctgcactatgcccgcgtacgcggtcagcgtcagccgcatacggcgaccggcattccgctgatgcatctgcccgctgacccctggagcgcggtgtgttccctggaggcgatccccgccggtgcgggaatcggtgcacggcttggcagcgtccgtattgcgctgttccgctttggcaacgactgttacgcactggaagatcgcgagccaggcagcgatgccagcgtcctgtcccgtggcatccttggcgatgtggcgggtgaacctgtggtcatttcaccgatctacaaacagcgcgtgcgcctgcgtgacgggcaaagtctggataacccgcagcaccagctgcgttgctggccggtgaaactggaagccggtcaggtttgggtcgccaaccgtccactgaacctcatggcgcaggcatcatgaaaaccacctgtgcctattgcggcgtgggctgtggcgtcgaggtgacactgaatcacagcgaatctgcacaggtgagtggcgatccgttgcatcctgccaatctcgggcggctgtgcgttaaagggacggcgctgggggaaaccctgacccggacaggacgcttactgcatccccaaattaaccaacagccggtcagcatggcggcagcgctggatgccgccgccgatggactccggcagattatcgcggagcatggcccagaggcggtggctttttacggttcaggccagctgctcacggaagattactacgtggcgaacaagctgatgaaaggctttcttggcgtcgcaaatatcgacaccaactcgcgactgtgtatggcttctgcggtggtgggctacaagcgcgcgctcggagcggatgcggtgccgtgctgttatgaggatctggatcaggccgatgcgatcgtcatggtcggctctaacgcagcctgggcacatccggtgatttttcagcgcctgaaacaggcaaaacagcaacggcctgagatgcaggtggtggtgatcgatccccgtcgcaccgccagctgtgacatcgctgatgtccacctgccgctgcgcccgggcagcgatccggcgctgttttcgggcttactgcactggctgacgcagcatcagggaatagatgcgacgatgttgccacatctggacggcgttgaaaccaccctgcaggccgccagccagtggggcattgccgaggtcgctgaacactgtgatctgaccgaggagcaggtggtggccttttatcagctgtttgcccggcgtgaccgtgtcctgacgttgtggtgcatgggtatcaaccagtcacagagcggcagtgacaataacaatgcgataattaatgcgcatcttctcagcggaaaaataggccgtcccggctgtgggccattttcactcaccggccagcccaatgcgatgggcggacgtgaagtgggcggcttagccaaccagctggcggcgcacatgagctttaacgaagcggactgcgatcgtgtacagcgtttctggcacagcccgaccatggcgcgccagcccgggctgaccgcggtggcgctgtttgacgcgattgagcgaggtgaggtgaaagccgtctggatcatgggaaccaatccggcggtgtcaatgccggaaggcaaccgcgtggcgcgggcgctggccaactgtccgctggtgatcgtctccgacgtgctggcgcaaacggataccacagcctttgcccatattctgttacctgcccagggctggggcgaaaaaaacggcaccgtgaccaattctgaacgacgtatttcccgccagcgcgcatttgttgcacccgccggggaggccaaacccgactggtggctactggcgcaggtggcgcagcggcttggcttcgcccaggcatttaactggacccatccggcggcgatcttccgcgagcacgcggcgctgtccggctttgagaaccacggcgaacgcgccttcgatatcagcggcctggcgcagctcagcgatgccgagtgggatgcgctgacgccaatacagtggccgatcaatgctcaacatccgcaaggctgtgcccggctgttcagcgaccggcgtttttatcatgccgatggcaaggcacggctgctgccaccggccacgccgtcgccgttggtgcgcaatgcccgttatcccttactgatgaacacggggcgcatacgcgatcagtggcacaccatgacgcgcaccgggctggtgcctcgcctgatgcagcactgtgacgagccttttgccgccttgcatcccgaagaggcgcgccgttatggcttgtctgccggggcgctggcgcgcgtgcagtcagaatggggatggatggtggtgcgcgtgacgctggacagcggcctacggcgcggtgaactctttgtgccgatgcactggaaccgccagttcagcctgcaaggcaatgtcggtggcgtcgtcgcatcgacccgctgtccggtttcggcccagcctgcctttaaacaaacggcagtgcgcatccagccgttagtaacctgctggcagggctggctctggcagcgcgacagtaccgcgcccgccgcactgcgctactgggcgcgtacgccgtacgccggttcgcaacgttttgtggtggccggagaggccacgccgcagcgctggctggcgtctcagttcaacctcgaaggctatcagctgcaaactgccagcgggggcgatcacagctaccggctgctggcatggcgcgaaggcgagctgcaactggcattttatgccgatcggcgtttacccgaggtagatcacgatctggttgccctggcctttcgtcaggcccccgcggacgcggctgaacgtcatgccttgctggcggggcaggcggcgcagagccctgcgactggccgccttatctgtagctgttttggcgtaggcgaacaaacgatattgcatgccattagccagggttgccacagcacccaggcactgggcaaaacgctccagtgcggcaccaactgcggctcctgcttaccggagctaaaacaccttctgctttccgtctctgtcccggaggaattatgacgctggcaatacacgctttagataaactgctggcgcctgagaaggcgtccagcgcaggacgcgtctggttagtgggtgccggaccgggagatgtcgaactactcacggtgaaggcgctacgtttgctgcaccgtgctgaagtggtggtctatgatcgcctggtcagtgaggcggtcatggcagaagtgccagacagtgcgctttgcattgacgtcggcaaacggcccggtcatcacggcctgaaacaggcacagatcaatcaactattagtcgatctggccaccagcgggcgcaacatcgttcgactaaaaggcggcgatccctttatttttggtcgcggtggtgaagagatggtgagcctgcagcaggccaacattgtctgcgaagtggtgcctggtatcaccgccgccgtggggtgcgccgccgcaagcgggattccgcttacgcatcgggattgtgctcagtcactgcgctttatcaccggacacggacgcagcggagagcctcaactggatgccgccgcactttcagccactaaccagacgctggtgttttacatggggctgagctggagcagcgtgattagcgcccggttgtgtgagtgcggtcgcagggaggatacgccagtagcgattattgaaaacggcacgcgccaggatcagcgggtgctgatcaccacgctggcagggctgccggagaccattgcgcagcaacaaccggtttccccttcattgctgattgttggcgatgtcgtccgctactaccgtgccgatctgcttgcccaacactgtacagaggcggctatccgccaggcgtgatagccagattgtgaccggatgcgcggtgacatcagggggcacggcgagcgggtagcggtgcgaccagaaccttcacgcccagcgcttcaaacgcgctgatgtgggcctgactgatcccgctgtcagtaatcaggtaatgaatatggctccagtcgcaggggagcgcaaacatcgacactttatcaatcttactggagtcggccaccacgtagacggtgctggcggatttgatcatcgccattttcactttgatatcggtttcgctgggaaagctcaggccgagacgtggcgagatacaggcggtggcgagaaacagcttctccgacagcacattctcaaagaagctggcggccttgtcaccggaggtcgaaagcgtcggaaatttaaacgtaccgcccgtcagcagcacattgatccctggctcgccgcccagcttcagggcgatattcacggcggtcgtcaccaccgataaacgccggatatggctgatggcatcggcgatagccgtggtggtggtaccggaatcgaaaatcaccgtatcaccgttttcgatatgctgggctgccaggcgtccaatcgcgtctttttcttccatgtgggtctgacgttccagctgcagcaggccggtattctgcttgcccgtcatcagggtcgcgccgccgtgataacgctgcacaaagccctgcttttgcagcatccgcaggtcggtgcgcagcgtggcttcggtcagtccgaacgtcttcgtcagcgcttttaccgtcaccgttccgtcttcccgaatcatctccaggatcttttctcggcgctgttgcatttcagctaactgctcagttttgcttttcaatcgaaacgctccctcttttaatcgcatcgggcttatggcgataacgcgttgtcgcagagtttaacccgcaggtttcgcctttgcgagtcggcaaataaagatgttaattttcgttcgaaagtgtatgtgcgtcacttttcatgacttttgcatccgctacagcagtgtaatccctctcttcctacccgttagcaaccgcgatcacgcgcttttaaccgaatgaagccgtcagacaggcagtgttgcgaaatttgatcttagccacattaaccatcaattcgatagcttatatttttgttcgaaaatgaatgcggcaaataaaataccaaagaggacaggcggatgagcggtgaatatgacgttaacctgcgctatggcgtagataccacaatgaacctgagcggcaaagtggccgtggtaacgggcgggctgggcggtatcgccatggccagtaatcagatgctgctggagaaaggggcgagcctggcgctgctttatccgccctttgaagcggataaggtcgacagcgcgcgcgcagccctggccggacaggtgcagtttatttgctgcgatgtaaccgatcctgccgacgttgagcaggctttcgatgccattgttgaacactacggtcatctcgacattctggtgaactgtgccggctacgtgatgcttcagccggtgctggaaaccgattttgccgaatggcaaaaacagatcgccgtgaacctgaccgggccgtttctttgctcacaggccgcgggcaaacgtatggtcaacgccggaaacggcggcaaaatcattaatatcgcctcacaggcggcgtccatcgccatcgacaaccacgttgcttacacctctgccaaagccggtttgctgggcatgaccaaagtgatggcgaaagagttcgccccgcaccggattaacgttaataccctgtcgcccaccgtggtgctcacccctatgggtgaaaaagcctggcgcggcgagaagggcaccgaaatgaaaaaactgatccctttaggtcgctttgcctataccgacgagattgccgctgccgtgctgttttttgccagcaacggcagcgacatgattaccggtgccgatctgatgatcgacggtggctttaccatctggtaaggccaccgccaggcgtccgtttccccctgccataacaacaatagcgagacacaccatgaaaaaaacgacgttgctctgcaccacgcttgccgcctgtttgttttctcacaccgcgctggcggttgaaaaaggcaccatcatgattttggttaactcactggataacccctattacgcctccgaggcgaagggcgcgaatatgaaagcccaggaactgggctacaagacctcggtgctctctcacggggaagacgtgaagaagcaaaatgaactgattgatgcggctattggcaaaaaagtgcagggcattatcctggacaacgcggactccacggccagcgtggcagccatccaaaaagccaaacaggccggtattccagtggtgctgatcaaccgtgaaattccggtggacgatgtggcgctggagcaaattacccacaataacttccaggccggttccgatgtggccaatgtgtttgtcgagaagatgggggaaaaagggaaatacgccgagctgacctgcaacctcgcggacaacaactgcgtcacccgttcaaaatcctttcaccaggtgctggaacagtatcccgatatgcagagcgttgcgcgccaggatgccaaaggcacactcatcgatggcaagcgcattatggacagtattcttcaggctcacccggatgtgaaaggggttatctgcggtaacggcccggtggcgctaggtgctatcgccgcgctgaaagcggccggacgcaacgacgtggtagtagtgggaattgatggcagcaacgatgaacgcgatgcggtacaggccggaacgttaaaagccaccgtgatgttacaggcgcaggcgatcgcggctcagggcgtgacagacctggataactatatccagaaaggcacgaaaccggagaaacagcgcgtgatgtttcgcggcattttgatcacaccggaaaatgcaaaaaacgtacaggactttaactacaagtcgtaatccatcgttgtcgcgcccgtactgacgggcgccagggagaatgtcatgtacaaccgactctggctgataccgatcgtgatggcgctcggtggctgtcgcattgtgtcgcagcaggaactggcggatcttaagaacccacccaatccccatatggcccatatcaatcaactctggcagcagacgttagtgccacaaatcgtcgcgcaggcgaaaccgctgagtgagttcacacagcgcctgcagtcagagaaggatctggacagcgtctgtcgcgcgctgggctatcgggcgcagagcgagaatccctgcatatttagcgtcagcgtgagcggggaagtcaccgcgctggataccacctcgcgcaacggcaaaatgaaaattaaagacgcatcaggtgacactgtcacggttcaggttgggccgatcattcgcggaacggcattgcgggatgcctacaaaggggccagctatcaggactttaacgatcaggtgctgttcagcgactttggcaaagccatcaatcagcaggcggtcatcatgatgcacaacgccggggtaaaacccggtgaccgggttaacgtggtgggcgtttttagcagctgggatatcccgcatacgctacccgatatcacgccagcccacatcacgcgtcagtaaggagttgatcatgcaggttactgagcagcaagacgacgtcattattgagacgcggggcctgtcgcgggtctatccgggcgtgaccgcccttgatcaggttaactatcgggtttatcgcaacaaggtcaatgtgctcatcggggaaaatggagccggtaaatccaccatgatgaagatgctggcaggggtggaaagtccgtcgtctggcgacattttgctggatggcaaacctgtcaggctgcattccacccaacaggccgaaaaactgggcatcagcatcatctttcaggagctgaacctgttcccgaatatgaatgtgatggacaacatctttatcgccaacgagttcttccagcgcggcgttatcaacgaaaagtatcagtatcagctggcaaaagccttgctggaacggctggagctggacgtcgatccctatgctgcgctggatgcgttgggcattggtcatcaacagttggtcgagattgcccgcgcgctgtcgaaagatacacgcgtgctgattatggatgagccgaccagcgccctgagtcagtcagaggtcaaagtgctgttcaacgtcattgaacagctcaagcgacgcggcgtcaccatcatctatatctcgcatcggctggaggagctgatggagattggcgaccacattacgatttttcgggatggccgttttatcgccgcgcgtgaagtgcgcgacgtcagcgtgccctggatcattgcgcaaatggtcggggacaagaaaaaacattttgactatcaacccgctcctcagggcgacagggtgctgcaggtgaatggcctgaccgccctgcatcaaaacggtggctaccggctcaacgcggtgagctttagcctgcacaagggggaagtgatagggatttatggcctgctgggggccgggcgaaccgagctgttcaagggacttacaggattactgccttgtcagagcggggatatccagttaagcggtcagcggttggacaactgcagttttcagcagcgccttaagcgcggtatcaccttggtgcctgaggatcgtaaaggtgaaggcgttatcgaactgatgtcgatcaccgctaacatgacgctctccagtctcagcctgcgcggctttcgacgcgcgctgggcatcgtgcatcctgacaaagagcggcagcgtgtgaatgaaatgattcagcacctggcgattaaagtcagcgacagcgagttacccatcagtgcgttaagcggcggaaaccagcagaaagtggtactgggaaaagccttgatgaccgggccaaaggtggtgctgttggatgagcctacccgcggcattgatgtgggtgccaagaccgatgtttatcacctgattggcaaactggcgcagcaggggctggcggtgatgttttcttcgtcggaactggatgaggtcatggcgcttgctgaccggattctggtgatggccgatggtcgcattactgccgatctgccccgtgccgatgctacgcgcgaaaaactgattagcgcgtccaccccgcaagcctgaggttgctggagaataagatgaaccaaaaatatctgctgtacatgtacttactcaaggcgcgcacctttattgcgctgctgatcgtggtcggcttttttagcgtaatggtgcctaattttcttacgccgtcgaacctgctgattatgacccagcatgtggcgattaccgggctgctggcaattggtatgacgctggtgatcctgactggtggcatcgacctgtcggtcggggccgttgccgggatctgtggcatggtggcgggtgccttactcactgtgggcgtgccgctgtggggcggggatcggctgtttcttaacgtgccggaagtgattctcgtcgtggcgctgttcgggatgctggtcggcatggttaacggcgcgatgattacccggcttggcgtagcaccctttatctgcacactgggcatgatgtatgtcgcccgcggcgcggcgctgctgtttaacgatggtgcgacctacgccaatctggtgggcattccggcgctgggcaataccggcttctcattactgggttctggcaccgtgctcggggtgtttattcccatctggctgatgattggctttttacttcttggcctgtacctgacgcgtaaaacgccgcttgggcgctatatctatgccaccggcggtaacgagtcggcagcgcggctggcgggcgtgcccattatcaaagtgaaagtgtttgtttatgccttttccgggctgtgcgcgggattagtggggttggtggtggcttctcagttacagaccgcgcatcccatgacgggcaatatgtttgagatggacgccatcggcgccacggtgctcggcggaacggcgctggccgggggacgcgggcgcgtatcaggttccattatcggtgccttcgttatcgtttttctggccgatggcatggtgatgatgggcgtcagtgatttctggcagatggtgatcaagggcgtggtgattgtgaccgccgtggtgattgaccagttccagcagcgtttacaaagcaaagtgatattactgcgccgtcatgaaaaaaagcagccagtgacgcggcaagctgacatccgtcatggataacaggagagaacaatgacccgagatttcaatggaaaaacggtggtgatcaccggtgcctgccgcggtattggcgcaggcattgctgcccgctttgcccgcgagggtgcaaacctggtgatgttgtccaattccgaacgcgtatttgccacggccgacagcctgcggccccttgccgcctcgattctggccctgcaggtggatgtaaccgatgaaggcgaagtgcagcaggtgtatcagcaggcatttgagcgctttggccggatcgacgtctccattcaaaatgcaggtgtgattaccattgatacttttgacaacatgcccaaaagcgatttcgaacgcgtgctggctgtgaacaccacgggtgtctggctgtgctgtcgtgaagccgccaaatacatggtgcagcaaaacggcggcagcctgattaatacctcttcaggccaggggcgcaaaggctttatctatacgccgcactacgctgccagcaagatgggggtgattggcattacgcaaagcctggcgctggagctggcgcgctggaatattacggtcaatgcgttttgccctggcatcattgaaagtgaaatgtgggattacaacgatcgcgtctggggcgaaattctcagcacggagcataagacctacgctaaaggcgagctgatggcggagtgggtggagaacattcctcttaagcgggccgggcaacctcaggacgtcgcagggctggtggcttttctcgcatcggatgatgcgcgttacatcaccgggcaaaccgtgaatgtggatggcgggctgatattttcctaaaaccgggttgctaccggcccgctgtgcacagggtcggtggctgccttcagcacaaatatcgagtcaagtcatgaatctgggtcacattatgctaaaataatcagcgctggttttgtttttctttcagaaaaccacctgatgatttttctgcccggacgtaatgatttgatgcttaaacctgtgactttctttctggcttcactgaccacgcttgtagcgctgcctgccggtgcgctgcaaacggacaatcaggtgccagaaaccccctttggcgatcctgcgcgctttcaacattcactggacgaccttccttctttgggcaacgtcgaagataacaacgaatggagcgaaaggctggcgaaggcggccaaaagcatcgcggaagccagcgaaagcagcagtgatttaaccctgggcgagcaggccgggcagtgggcttttgaacgactgcgcgatgaagtggctacgcgggttgagaatgaaggccagtctctactgtcaccttatggcaacgccgagttcaacttaaacgtcgatatggacggtaactttgagggcaccggcggcaatctgtttagcccgctcgccgacagaaatcactctctgacgttcagtcagctcgggcttcatgactccgttgaaggtgtggtaggcaatgcggggctgggtcagcgctgggacgcgggcaactggttggtgggatataacggttttatcgatcgcagttttcgcagtggacttcagcgtgcgtcagtcggcaccgaggcctggagcagcaatctgcggttgtctgctaactactatcatccgctgtcgggatggcgtaatcgcggtgacagccaacaatatcgcatggccgaaggctacgacattaccagccaaagctatttgcctttttaccgtcaactgggtgtgtcattcagttatcagcaataccttggcgaaaaggttgacctgtttaacagcggcaatcgctaccataatccggccgcgctttcgcttgggctgtcttatacgccggtgccactggtgaccttctcggccagccataaaaccagcagtgccggtgagagccaggaccagcttggcctgaaacttaactatcgctttggtgtggcgctgagcaagcagttggatgccaacaacgtggccgaagtgcgttcgttgcgcggcagtcgctacgacaccgttacgcgtagccaaaacccggtgatggcttaccggcagcgtaagacgttatcggttttcctggcgacgccaccctggcagctcaatcctggcgaaagcgtaccgcttaagcttcagctgcgcgccagtaacgcgattaagtcgcttagctggcaaggggacacccaggcgctgagcctgacatcgccgccaaataataatgtgaccgacggctggagcgtgattgttccgccctgggacagcacgccgggtgccagcaatgagtaccgtttgtcagtcacggtggaagacagtaaacagcaacgcgtaacgtcaaactggatcaccctgcaagttaaaccgcctttgtcgatggatgaaccgcctggcggaacaatgtcgtcctccgccagcgggctgagcttcacggaataacggcaaaataaagtgtgatttgcgtcatgcttttttcgctggaaattacgtactagctttcgcagaagcagccaaaccacgacctgtctgcataacatgattcgtcatctacccgatctctgggtgatccgcctgttgccctggcacctgacctgcacgcgatgacgtagcaggaagcgaagtttatttcctgcatgttttgtcgctggctacgcaggcagacgagcggggatgctgtttggggataaaaatgaccctttgccgatggaacaatctgcatcgatattgaaatctacctgcgtgaaaggcgtgaaaggcgtgaaaggcgtgaaaggcgggggagcgggccgatgcagccgaatcgcttttatcgattgccgctgatatgccgtgttctaaagaaaaacggcccgtcagacacaggccgggccgttgaacaatgagggtgatttatcagaactggtaggtcatacctacgcccgtcacgtcgtctgttgccagacctaacgggttgtttttcttcagcaggttgattttgtactcggcatagactgacatgtttttgttaaagtagtaggtcgcacctaacgccgtatatttgtacagatcagcctcgccaatcccttcaagatctttcgcttttgacgcgacatagcccacagacggacgcaagccattcaggaactgatactgcgcgaccacttccgtgttttgtgttttgttggcaaaaccgttggaaactggcatgggtgtagcattgagggtttcaccatacatggctgccagatagatctggttagcatcgtattttaccgctgttgcccacagctgagctttattaccccggccaaatgtggcggtattttgtgctgctatgcggttcaggctggcataggaaccgacaaagctcagaccaaagtcaaagtcgtaggacgttgacagggcaaagccatcgccgttagaacgacgtacttcaaggccattgtcctgggtgctggtgcggtcatttttgccttcatactgcgcagcaacgttccagccttttaccagaccaaagaagtctttgttgcgccaggtcagcaggccgcccgagcgcaggctcaggaatgcatctgagttagcagaatcgccgccaaacacgggcagcatatcggtatagcccagcgcgtcatagaccagaccgtagttacgaccgtagtccagcgatcccagcgcgccatatttcaggccagcatagcccagacgagttttgttgccgctgttcgcgtcactgccttcagagtttttcaggctgtactgatattgccagaaaccgtaaccggttagctgatcggcgatggacgtttcacctttgaaacctaagcgtgtataactggcgtcgctattatttgacttatcgtcagaaaaataacgcagtacgttaaccttgccttgaatatccagcttattcccgtctttattataaatctgtgcggcctgagcagtagacagaccgatcagtaacggcattaatgccgccactaatgtgcgcttcatcatttattatttaccctgtggttatattattatttcccctcttttggggtgaaaagaaaatgacacaaattgttaattcagcctagcgcaataagtgtaactaaatgtgtacccaggggaactaaatctcaataaagccaattcggcggccatggtgcgcctgtcagtgttttttcttatgaccccattagcaatgcaaaggataaaaaggcatataaaacaggggattgttgatttcatcgggaagggataaagcaatatggcaaaaaaatgataacaccagcgatcttgcttgaaaaataaacgcattttgtatgataaataaacaataaagattttccatctaatcattagcgcgcttattaataatttatccagttctaaataatttattaatgttctgatgataacccgggaaacaatattaacggcttcgcataagtatatttaaacaaataaagagagcatattttaatcacccgccagtaataacctgggttattactcggcttattgcgtttacttttttacggatattgaccacagtctgcactacacacaggcaactgccccattttggggcggtttctgcacgtttttgagcggataatttatcagcgatcacaaaagcgatatttcatcccgccattgcataattccgctttaaaaagctctgctatcggcccccgttaagataattattcactatttatgcaaataaagtgaatgatggccttttgtaacctattgatatttcgtcaggcaatccgttttatgcattttagtccttggctggcacgctatctgcaaactagagtagggccagattcattacatttttaacaattaacaaacaattacgttacccgctggggaacaggagaagggttatgtcactgcaggtttcgcgtcatgattttgatcaatggatgatgcccgtttatgcacccgcgagtttcgtaccggtacgtgcggagggatctaccgtctgggatcagcaggggaaagactatatcgacttcgcaggcggcatcgcggtcaacgctctcgggcatgcgcatccggcgctccagcaggtgcttcaggatcaggcctcacggctgtggcacaccggcaacggttatacgaatgaacccgttttacgcctggccaaacagctgattgatgccacctttgccgaccgggttttcttttgtaactccggtgccgaggccaacgaagcggcgcttaagctggcccgcaaggtagcacacgacagggttggaatgcataaaagcggcatcgtggcgtttaagaatgcctttcatgggcgcaccctgtttacggtttctgcaggcggtcagccagcctattccaacgattttgcgccgctgcctgctgacattcagcatgccacatttaatgatcttgcctctgcggctgccctgattaacgacagtacctgcgccgtgattgtcgaaccgatccagggggaagggggcgttgtgcctgctgaacccgcgttcctgcgtgggttgcgtgagttgtgtgataaacatcaggcgttgctcatttttgacgaagtgcagagcggcgtgggacgcaccggcgcgctgtacgcctatatgcactatggcgtaacgccagacgtgctgaccagcgccaaggcactgggcggtggcttccctattggtgccatgctgacgcgagaagatctggctcaggtgatgggcgtaggcactcatggcaccacctatggcggcaatccgctggcgggtgcggtggccggaaaagtcatggaactgattaaccggcctgaagtgatggacggcgtcgcgcagcgtcatgcctggattgtggcggcactggacgacctcaatcaacgcctgcacctgtttaaagaggttcgcgggttgggcttactgattggtgctgtgctcagcgacgactttgccggtaaagcgaaacagatcaatctcgcggctgccgagcagggcgttatggtgctgattgctggtgctaacgtggtgcgcttcgcgcctgcactgaacatcagcgaacaggaagtgaagaccggtatggcacgctttgcccaggcctgtgaacacctgctacagggaaacgcatcatgatggtgatccgtccggttgagcgggacgatctcagccagctgatggaactggcggccaaaacgggcgggggattgacctcgttgccggttgacagcgccaccttacaggcacgaatcgaacgctcgctacaaacctggcagggcacgttgccgcgtgccgagcagggctatgtgttcgtgctggccgacagtcacgataaccgcgcggtggggatctgcgccattgaggtggcggttgggcttcaggaaccctggtataactttcgtgtaggaacacaggtgcacgcctcgaaagagctgaacgtttacgccgccttaccgaccttatccttaagtaacgatcatactggcagcagcgaactctgcacgttgttcctggatgccgactaccgcgatggcaaaaacggttacctgttgtcgaaatcacgctttctgtttatggcgaatttccgcgaacactttatggcgcgggtggtcgccgaaatgcgcggcgtgagtgatgagcagggacactcaccgttttgggacagcgtaggcatccacttcttctctatggaattccgcaaagccgattttctcagtggcaccgggcaaaaagcctttattgccgaactgatgccaaaacatccgctttatctgcactacctcacgccggaagcgcaggccgtgatcggtcaggtacatcctaaaactgcacccgcgcgtacggtgctggaagccgaaggctttcgctatcgccagtatatcgacatcttcgatggcggcccgacgctggagtgcgatatcgatgacattcgtgcagtgcgcgagagccggttgcttaccgtacaaaaaggtgatgtacagcagaatgcgccgctctgtttagtggcgaataccgattatcaccagtttcgcgtggcacttttaccggttgatccgaccacgcaacgtattcagctcaatgatgaacaactgcaggcattacagtgccagccgggcgacagcctgcgcgtggtcacgctgtgcagtgaggagaaaaaagcatgacgcaccttatcaacggacactggatcaacggcgagtcagggcgctttacaaaacaggacccggtgagtggcgacctgctgtggcaagggttagccgcctcgtcagagcaggtaagcgcggcctgtcaggcggcgcgggcggcgtttccggcatgggcacgacagccttttaccgcgcgtcaggccattttggaacgctttgcggcacagcttgaggcgcacaaaacggcgctggccgagatcatcgcccaggaaacgggaaaaccacgctgggaagccctgacggaagtcacggcgatgatcaataaaatcgccatttcagtgaaagcttaccatcagcgcaccggtgaacagcagcagggtgagagcgccctgcgccaccgtcctcatggcgtgctggcggtctttggcccctataactttccggggcatttgcccaacgggcacatcgtacctgccttactggccgggaattgcgtggtgtttaaaccgagtgaactgacgccggctaccgcagagaaaactcttcagctgtggctggcggcgggcgtgccggccggtgtcattgggctgcttcagggcggtcgtgaaaccggtcaggcactggcggcggaaccggacatcgacggactgctgtttaccggcagcgcgcacaccggctatcagttacatcgtcagtttgccgggcaaccggaaaaaatgctggcgctggagatgggcggcaacaatgccttgatcgttgaggaccctgcggacacggatggtgcagtacatattgccattcagtcggcatttattacggcaggtcagcgctgtacctgcgcccgccgtctgctggtgcggcgcggtgcggcgggcgatgcttttctgcaacgtctggtcgaggtggccgcccggctgcagcccggcgcctggaatgccgatccgcaaccctttatgggcagtgtgatttcctgcgccgctgccgaaaagatttatgccgaatggcagcagcgcgtggcgatgggcggcaaggtgctgctggagatgcgttggcccgatcgtcaacaggcgttgttaacgccggggattatcgacctgaccgaggtagacaatgtgcccgatgaagaggtgttcgggccgttgctgggcgtgattcgttatgacgattatccgcaggccattcgtctggccaaccagacacgctatgggctgtcatgcgggttgatttcgccgtctcgcgcgcagtttgaacagctgctgctggaagcgcgtgccgggatcgtgaactggaataagcccctgacgggcgctgccagcacggcacccttcggcggtatcggtgcatcgggtaaccatcgtgccagtgcctggtatgcggccgattactgcgcctggccgatggcttcgctggaatcgtctcagcttacgttgcctgatgttttgtcaccgggcctggacttttcgccgcaaggagcgcgttcatgaaagccattgaagcgaatttcgacgggctggtcgggctgacgcaccattatgcggggctgtcgtttggtaatgaagcctcgacgcgcaaccagcggcaaccctcaaatccacgcctggcggcaaagcagggcttgctgaaaatgaaagccctggcggatatgggttttgttcagggtgtgatcccgcctcatgagcggcccaatatcgcggtactgcgccagttggggtttagcggcagtgatgcgcaggtactggaaaaagccgggagaaccgcacccgcactgttgtcagcggccagctcggcctcggcgatgtgggtggctaacgccgccacggtttcgccttctgccgacagcgccgaccaccgcgttcatctcaccgtggcgaatctcaataataaatttcaccgtgcaattgaagcgcctgaaacgacggcattgttgcgggcgatatttcgcgatccccatcacttcaccgtccatgaggcgctgccccaggtggccatgttcggcgacgagggtgccgctaatcataaccgccttggcggggactatggcgatgtcggaatacagttgtttatctacggtcgcgataactcgtctggcgcggccccgcagcgctatcctgcgcggcaaacccgtgaggccagcgaagccgtcgcacgtttacaccagcttgcgcctgaccaggtgattttcgctcagcaaaatcccctggtcatcgatcagggcgtttttcacaatgatgtgatcgcggtcagcaatcagcagatgctgttctgccatcagcaggcctttgtcgatcagcccgggttgctgaaccgtctgcgtgaacgtgttccgggctttgtcgcccttgaagtgcccagcgcacgtgtttccgttcaggatgcggtcaatacttacctgtttaacagccagcttcttacccgtgccgacggcagtatgatgctggtgctgcctgaagagtcacgccagcatcagggcgtttgggattatctgcgtgagcaggtggaaagcgagggacccttacagtcattacaggtgtttgatctgcgtgaaagtatgcataatggcggtggccctgcctgcctgcgtctgcgcgtggtattaacgccagatgagcaacgggccgttaaccctgcggtactgatgaacgatcgcctgtttacttcgctaaatcagtgggtcgatcgccactaccgtgacagattaacgcaagacgatttaggcgatccgcaattgctgcaagaagggcgggttgcccttgatgaattgaccaggctgctagacttaggaaatgtgtatgcatttcagcagtgaagcaggcgttgccatgagggctgcctgcttccggtcttaggaggaacgatgcaggactttttacagcagacgctgtctggtgacgcaccgcgtatgcgtagaggtgagacagcgcatcttcgctggcagtggttgtatcacggtattctgctcatggagccaaagacgcctgtgaaacaggcgttggtactttcggcagggattcacggtaatgaaaccgccccggtagaaatccttaaccagcttattacgcctttacttcagggcgaaaagccacttcagcagcgaatgctggtggtattaggtaatccttcagcgctgcgtgcgggaaaacgctatgtgggatatgacatcaaccggctgtttggcggtcgctggcagcagattgacgacggtgatgaagcgcgccgggttctccgtctggaacagatgctggagaacttctggcaactgggtgagtgcgatgaaacccgctggcacctggatatgcacacggcgctgcgcggctcttaccacacgcgttttggcgtaatgccgctgaatgatcggccatggccagagccctttttgcactggctggcggttgccgggcttgaggcgctggtctttcaccgttcgcccgcgggcacctttacccattttagctgtgaacactttggtgcagccagctgtaccctggagctgggtcaggcgcgaccttttggcgaaaacgatttggcgcagttcagcgctgtctctcaggcactggcagcattgctgtatggcgagcccttgccggaagcgcaatctgttccgcgccgctatcgggtcagtcagcagatcacccgccacagtgaaaagtttcagcttcatatgagcgacgacaccaagaactttaccgcttttccgcagggcgctttgctagcggaagacggggaaaggcgctatttcgtgcagcaggcgcgggaatatgtgttgttccccaatccccgtgtggctctggggttgcgggctggactcatgctgattgaagagagtgagcaaacccaggctttgcccctttgacgtcatcgatacaaaatagcggaagacaccttccgctttactgctaaaggcattacaattctccacgatttatccgaaatctcctgattattcatactctttttcaatttctgacgcctttcttcttaatccctccatgattgcctgaattgtggcttttgcgctttcacgcttttactctcgctcgcagtaattgacgttcaacgtcgtatgcttgtttccgaagacgcgacagagtgctgtcgttacgaaactgaacaagtgaataaaaaggacactgttatgcgtaaattaacttctctgttactggcttcaactctggcattcggcgcggcaacggttgttcatgctgaagccgataatctgacaccaccaccggcaggcacggaaaagccgatgcataaaccgatgcgtcacggtatggatatgatgtttggcgggctgaatctgaccccagaccagaaaaccaaaatgcatgaaattatgaaagagcgtcgcgatgaaatgcagcgcccatcacaggatgaacgtcgtgcgacgcacgccatcatcgcctctgacagcttcgacaaagcccaggctgaagcgcaggcagataaaatgaccgcgaatgccaaagccaacgcggtgaccatgatggaaacccaaaataaactgtataacgtgctgacgccggagcagaaaaaacagtacaacgcgaattttgaaaagcacctgactgaaaaacgtccgatgcacggcaagatggcgcctgcacctgcacccgctcaataagccgcacgttaatcagtaaagacggttgaagaccgccgaccttgtccacctggcgtgggcagtgtcggcggttttttttattctaaaggggaataatggggtaatggccagacaataccggactgcagagaattttgtagccgtcgtgatcgaacccgcctttgccgcgtttaagggactttgcctcgtccatcgtttgcacggaacccagatagaaccagtgatcgataacgtggatttgcgtcaggtgtttaccttcttccaccagtgccaccgcaccttgccatggccagcagaatacccggacgttttccagcgcggcgagcagtcggtcctgatgatcgctcacaggttccttgccacagcaggcaccggcgcagcggcgcagggcagaacgaaagcagccccggttggcactcaacgcttccagccctaacaagccgtggcacagctgatattcatcggcaagctgcttaagacgttccagcgcggcaaaacggctgcggtaaagaccaaacaggttcggcgactggctgaaatcgacgtcacgggcatacaccacttccggtttaccctctgcggtaatttgcagagaacaaagctgacgatttttgcgcaggcgtttattaaacaggggctgctgcgttttgatcatttgcgcttccagcagcagcgcaccgagatcgcctgctgtgggaatccagctgacgcgccgcgactggcgtaacatttttgcttcatcgggtgtacgaaaatgggacatcacgcgcgaacgcagattaacgcttttgccgatgtaaagcggcaaggtatcgctgtcgccatgaaaagtataaacgccgggctgatttggcaggccttcgagccattcacgcaaatgttccgggtattcataaatggttgccgcgtcaaattcgaggcgatgagtggctgcacgtctgaccaaaacggactcctgtactggttgtccatacagtgtaacaggcaggttaaaggttcgccagtcagagattcatcaacgccttgtcgccagccagcaaatcagagagccagcggtgatcatagcaacgccttgccagaagcttatcggtggcgtcagccccagccatagcgaggccagcaacgccgagagtaccggcgtgaaataagatgccgtcgccaacagcgtcaggttgccatgctggatgccgtaattccaggcagagtaggcaaccgccgttgacgcacccataaacagcacttctgctgcagcggtcacgctaaattgcagcgtttcatgctgcgtgaacaacacgaatttgagccatagcgccagggccgtcaccataaaaaacagggtgacaccgttgctgccgcgagcatagcggcgcgtgatgttgttgtagagcgcccacgcaatcgccgcgataaacgccagcaggtaggctgttggattgctggcaatattctgcgccatcttacctgtcacattcccgttagcgcctttcatcacccagataataccgcagagggaaagcagcagtccgggccacagccacaggcgaaaacgctgctggttaaacggaatcgccagcacgattgtcaggcagggccaaagatagttgatcatccccatctccagcgactggtgacgatcgcgggcaaggccgaccgccagcgccaggcaaatttcatacccgacaaacagcacgccgcctgtaagcagatagcggcccggcatgttacgtgggttgggaacgccgcgtgtgaggcacagcaaaacagccgtggtggagtagataagcgcggcaccaccagtcgggccaaatgcctcgctgacgctgcgcagcaggccgatagtggtgctccagagcaaaatcgcgctcaaaccgactaaggtcgcgcgtggtaagttagcaggcatggaaactcaatgtctaaaagagccgccagcgggcagcgagcgcgaaatatgctaacggtaagcctgtaccctgtccatcaggtattccgtctgggtagaggctgagtttgctgtaatggtctgtgtgctgagcaacgtttttccctcaacgcacctcatgaaaggcctgatcatcaggttgcttaacgccctttaccgaccgcaatccaacctgtcagggctttacctctgttgacgagcctcgcaagcttatcagccacgcgtaggcaaagggggatgcccacagtattacgtcttatggctttccacccacatgcggtggaacagagtgaagtgttaaggattagttagcgatttattgcagtgagtaaggatgtgtttttttatacattattataatgataagttgttgtttttttagaaattaatcaacgttaaatgcttaataaacaatgcttgtttttggcgctgttatcacatttttatgtcgatagttaaggtctgcgtctgaaattttcagacgaattaactttttaataagaaccaggtgaaaaatatgactataacacagcggcttttactgaccttttcccttctttgcatggcgctgatagccatggttatcgtggcggtttccgtagcggacggttttcagtaccgtttccagtatgtgcaggaaaataccattccttctattactgatatcgccaaaatggttgacggtagcaatgccattatcatcgcgctctatcatcatcagagcatgaccgatcccgctaagcagatgcaaattgagaaagaaatcaagggcgtcttaaaccatatttcgatgctcaaccggaattaccttaagaatgatatttccagtgaggaagatcgacagatgaccgaaaaggcatttgtcaccattaaaaagattgaggcggatctgcctgcttttctcacggcctcacgcgcacagaacgacgcgatttctttgtcgatgctacagggtaatagcggtattggtgcgctaacacgacagctgattgacgattatcagaaacagctgcaactgaatgtggatattggtaatcaacttcgtaaagagaatgacagcacctatcgtcatactttactcattctgattgccggttctgtttcagccatattgctgttaggcttttttacgcttaaaacaatttttgctattcgtcgtcagctcaacaccatgcgccacacaatggaaaccgcgagcggaaatctggatctgacattacgtgcagatgactctcgcggagatgaaatcggtctgacggcaaaggcatttaatcatttggtggaaaatgttgcactgtccctcagcgcagtagaaagcgcggctcagtcggtcagtacggcttccgcacagatttctgcaggcaacgaagatctctcatctcgtacggaagagcaggctgcctccctggagcagacggctgccagcatgtctgagttgagtgaaacagtgcgtcagacggcagaaaatacgcgacttgccagccagcttgcccaaaacgcgcgtgatatatctgaagacagtgcgtcacgcgtgaaggcgatgctgatgaccatgggtgatatccggacgagctcgacaaaaattactgatatcattgcgttgattgaaggtattgcattccagaccaatatcctggcgcttaacgcggcggttgaagcggcgcgggcaggtgaacaagggcgcggttttgccgtggtcgctggcgaggtgcgcaacctggctcagcgatcgtcttcttctgccagggagatcaaagcgcttattgaagcttctatgctccatgtagaagctggctcgaaccaggccgagggcgtgggtaataatattacgcgcatgacagacgcggtccgtcaggtgaccgatttggtcgatgagatttcggttgctgcaaacgaacagtcgcagggaattaatcaggtgcacctggccgtaaaccagatggatgatgtgacgcagcaaaatgcctctctggttgaagaagcatcttctgcatcccgttcattaattgatcaggcctcaacccttaaccagttggttgcgaccttcacgctcgccaaaacgcagcgccaggcaccgatccaaagcagcatgatcggacgtgcagaccgtattcagatgcctgtccgcagcccgatggcagcggcgggtgaagctgactggcagcgtttttgatcgggggacgtatcacgcagtcgcgcccggccactgagctgaccgggcgcgatgttaaagccggataaaggctatagggcgttatttccaaaagtcgtcgaaaacagtgataggcggacgacgcttatgctcggttttcagataccagccttcaataatcttcgcgctgtccggcgcgatggttttgccttccagatagtcatcgatcatatcgtaggtgacacccagcgcgacttcatcctgcaggccagggcgatcatcttccaggtcggccgtgggtttcttcagataaagatgttcagggcagcccagcgttttcagtaactgttttccctgacgtttattcaggcggaagatagggttaatgtcactgccgccatcaccatatttggtgaagaagccggttaccgcttctgcgccgtggtcggtaccgaccaccacacctttggacataccggcaatgctgtactgggctttcatccgttcgcgggctttttcattaccccgcacgaaatcggacagcacgatccccgcttctttcagcgcccgctcgctggccagcaccgcttctttgatattgatcaccagcgaacgatccggctggataaaggccagagcgtcctgacaatcctgctcatctgcctgtacgccgtaaggtaaacgcaccgcgataaaggtgtagtcgttatcgcctgtttcctgccgaagctccgttatcgccatctgagccagcttgccggtcagggtggaatcttgtccgccgctgataccgagtaccaacgccttaaggccgctgtggcgcgttaagtaggctttaaggaaatcaacgctggtacggatctcctggtgtggatcgatagtcggcttaacgccaagtgcggtaatgatttcctgctgcagtgacatcaacatctccttaagtctgtagcccgttggcacaatacaaagcatgttttaaagctaacgcgcatcccgggaaacaacaagccaaagcgaccgctgtttttattgagacgggcagaatcagacgctttttacttcggctgcgggttttttcgccagaacggtaaacgtcagtatagccagcatgtagcagccaaaaatcgtcagcgtcatactgattactgatgtcccgccaatgcctgttaccggcacggcaatagcgcccagggtaaacccggtgacgccaatcaccgccgatgcgctgccagcgcgctgtccctgactttgcatcgccagcgacgacgccgtcgtggcaatcaccccgttactggcaatggtaaagaacagggcgagtagcaccaacggcagaggcgcatggctgagcccggcaatcagcaacgcactcgatgcgacacaggccagcgtcagaccgcctttcaatacgcggtactctccccacagtgggcagagccgggcgctggtctgtgaggcgatgattagtccaataccgtttgcggcaaagcagaagctgaacgcctgcggagacaagccgtaaagttgttgcaacacaaagggtgaggcaccgatgtaggcaaacatgccagacatcatcagcccctgtgtgaggcaaaatcccataaaagggcgatgggtaatgacctgacccagcgcagcataggctgaaaatacagagccctgactacgacgttcggcaggaaggctttcatgcagcttccagcgcgccagcaggataagtaaaacggcgatgcagctcaataccacaaaaataccgcgccagttcagcacggccataagtgcgccacctaataccggtgcgccgataggggccaggccgttgaccagcatcagcagggcaaaaaaacgggtaagttcatgaccgctgtacatgtcacgcgccacggcccgcgacaggacggcgccacctgcgcctgctaagccctgacacaggcgggccagtaacagttggtgaatgtcctgtgccagggcgcagcctatcgaggcgataaacagcagcaccagggataaggttagcgggcgcagtcgaccaaatttgtcgctcattggcccgaaaaacagctgtccggcacccaatccgagtagcccggcagtcaggctgagctgagccgttgaggtcgaggtctgaagatcctgcgccagttgcggcagtgcgggcaggtacaggtcaatacagagcggccccagggcagccagtaatcccagggtgatggcgtaaacccgtcggtttggtgatgaaagcgtcattaatcctctggaaccagaatgcttgttggtgacaacgtcacttatgttgttcacccgccttgaaacgcgggccattagccattaaggcaggcctctcagcgccactattcgcctgaataaccgctgcgttaaggccattgcggcgcattttatcaaatctttcagggcagattgagtttaagtacgtcattaacttgaaaaaaaccgttttatgttccaggcttctcagcacatggacaaaaaaacgaggaacaacaagatgaataaagtgatgggatgtatcgctgcagcgctgacgctggctgcgctctctggttgtacgacttacgatcgtgcggaaagcttcgtgactaagcctgtggttaaggatgtcaaaaaaggcatgactcgcgaacaggttcgtcagattgctggccctgcagccactgaaatcacgatggtgcatgcacgtggtacctgccagagctacgtcattggcgagcgtgatggcaagccacagacttacttcgttagctataacgataccggtcgcgtgatgaactatggcttccagagctgtgctgagtacgatactgacccgcaggttaagcagtaactacccgctttaacaagaaacggctcgccatcaggcgagccgtttttttatgcctataatcccgccggacgagggacttcaatatagctgccgttaatttcccgctgataataatgaccgtcctgcacgtagaaacgcctgccgttaaaatccagaatccgcatgccgctttcataggtttgcacgggcggttccaccaccacgtattcttctccgtgacgctgataataactgccgttaagcaggtagtaagttaatccaccgatcaacaccgccgtcgcggccagtggcaaaacgtggaagtggtcgggaccgtgccagcgcggtgccgggccatgccagcctgggccgggtcgccagtgcgggccagggccccagtcaccgggacgaccaaaagcgtgagctggcgcaactatcgctaacgccagtaatgaggcgataaccgttttcatgagtgttctcctgcagttattacctgcagaattctctttttgccgcataaagacaagcagaaataccctgtattattgcccgtttaccacgcttaacgttttcttaacggcaccacgataatcaaggagaaaaatggagaagataagacagaaagaagggaaagacctggcggctggcgccaggtctgcagtgattaactgtgttctaattcaccgtgttcgctgcgttctaaaacgcgtttattggtcaggcccaaccagcggctggtcagggaacctgcagtcatggaaccattgacgttcagcgctgttctgcccatatcaatcaggggctcaatggaaatcaacagtgccaccagggtaaccggcagccccattgcgggcagcacaatcagggcagcaaaggtcgcaccgccgccgacaccggccacgcctgcggagctcaacgtcacaataccgaccagcgtggcaatccacagcggatcaaaagggttaatgccaaccgttggggccaccatcactgccagcatggtcggataaagaccggcacagccgttctgtccaatagtggcaccaaacgaggccgagaagctggcaatcgattcgggcacgccaagacggcgagtctgggcttcaacattcagcggaatgctggcggcgctggagcgactggtaaaggcgaaggtcagtaccggccagactttgcggaaaaaccgcataggattgatgccgttgaccgataagagcagggcatgaaccacaaacatgatggtcagtcctaagtaggacgccaccacaaagctgcccagcttaatgatgtcctgtaggttagaaccggccaccactttagtcatcagcgccagcacaccataaggtgtcagtttcataatcaggcgcaccagcttcatcacccacgactgcagggtatcgatggcgatcaggacgcgctggcctttaacctcatcgtctttatggagctgcagggcagcgacgccaaggaaggcggcgaaaatgaccacgctgatgatcgaggtcgggctggccccggttaaatcagcaaacggattcttaggaataaacgacaggattaattgcggcacggtcagatcggcgactttaccgacgtagttactctgaatcgcgctcaggcgagcggtttcctgtgcgccctgtaccaggccggtggcgttaagatgaaacaaaccggttacgaaaacgccgaccagggcggaaatggccgtcgtaaacagcagtacgccaatagtcagaaaactgattttccccagcgaagaggcattgtgcagacgggccacggcgctgagtatggatacaaacaccagcggcatcacaatcatctgcagcagttgtacatagccgttacccacgatgttgaaccagctaattgaggttttaacgatatcgctgttgccgccgtaaatcagctgtagtgccagaccaaaaagcacacccagcactaaaccggtcagcactttttttgacaggctccagtttgcgcggctcatgcgtgacaataaaagcagcagcacgacaaatgctacgacgttaagcgtaagaggaatatccatagcaactccgaagttatgcagcattccctggtaggagagcggcaaagatagtgatcgtaaagatacgtattcggaaatggtaacagttagaaatggcgcaatcttatatccaaatggaatagcttataaccgggactgttttgctcccggcttagcgttctgattgcgcagagatgagacgactgacgccgttttgcagcgtatcaaatacctgggccggccagccattttcgccaaacgacggcatccccagcgggaaccataaggcataaccaatcaggcaaagacaaagcgtacgctccagctgattgcctttctgactgttaagcactggcaggcgaaaacgccagcggcagggccagagcaggggaacgccggcgggggtgagcatatcagccacaatatggctcagataaccgagcgtcatgccctgcaacacatccgccgggacaggccagcttttcggcacgttgatctggaacaaccacaggctggctgccacggcaagcaggctgtgggtaaatccgcgatggccaaacacccgcgcaatagggtgcgacagccagcgcagccgctgtcctaacagggatttaggatggtcgatatcgggaagcaggcaggtcagtaacgtggccggaatcaaatgccaccagtcggcatgcgccatcactggggtaagttcggcccgtttagcgaaaatagcgctggcaacagcaaaaaagatatggccctcggccgtcatgataaaacctggctggaagaaaaactgtcgatgcatccagtatagggatttatccagtaaatgagaacccgtgacgctgtaacgaagcgttaattttttaaggttgtgcaacaggttacagcgtagccacaattaacccagcaaatgtgcgcgcgtcagctgtgtcaggctgctgagtttaacatcggccagcgaccagcgggcatcgtcctgatgcgcggcagccgggacgacaaccgcgcgcatgcgcgccgctttgctcgcgaccattccgttgacagagtcttccagggcgacacagtgaagcggatcgatacgcaacgcgtcggcagcatgtaaatacacctgcggatgcggcttactgtagggcagattctccgccgatgacagcacgtcaaaatagtggcgcaggttgaacatttccagcacgccttccagcataaacagtggcgaagccgagacaaggccgattttcaggccgtgctgtttgcacagtgtcagtgcggattcaacgccgggtagcagcgggcgctgcgtggcgatcagttccatcgcacgggcgatgatgcgctgagtcacttcttgctggctcggccctgaccagggcagggtttcgtaccacatgcgcacggtctggtcgatgcgcagccccagcgtatcggggagctcatggcggcgcgtcagatcgagattcagggttgaaaagatatccatttcggctctgtcccaaagcggttccgaatcgatcagcaatccatccatatcaaataaagcagcataaacagggcggtggtaaggcatgaggctctcccgtaaacatgacggcctactttatcacgaacgggggaggctcgctcaggagaggcattacgggcgcagcccgcgcttttttttgggaaaacgccctaagggcaggtagactagaggctaacaggattttgggttcaggagatatcatgacctatcaacaggctggccgcattgccatccttaagcgtgtcgtcggctggatagtttttttactggcgttagtatccacaataatctcactgctgagttttttatttaagcacagtgaaaagaagcctggcattgatgccgttatgcttgattttattcatgttatggtcgacatgattcgttttaatacgccgttcctgaacgttttctggcataactcacctgtgccggactttaacggacagatgaatctgggattctggcttgtctatattttgatcttcgtcggtctggcgctggaagcttcaggttcccgcatgggacgccaggcgcgccacgtgcgggaaggcattgaagaccagatgattcttgaacaggctaagggcagtgaagggcgcacacgtcagcagttagaagggaaggtgcgcgtacctcgccacaccattttcctgcagattttcccgctctatattctgccggtggtgattgccatcgcgggatatttcctgctttctctgctgggttttctgtaaccggtcaggccggtttagcctgaccggccgccagtgcatcatcatccagtagctgacctacggcaagctgcgcggctcccagccagttgccgccaaagacgttcgcccgatttagcagataataaagctgatagaccggctggcgctgtgagaagccatccggtaacggccaggtctggttataaccgtcaaagatttctctgggcagatcgttaaaccagctcagcatggccaggtcacattcccgatctccccagtaacaggccggatcaaaaatccatggcccactctggctggctgcgcaattggtgggccacagatcgccatggagcagagaaggttggggatgatgtgatgccagcgttcgctgcacgcagtcgacaatcagatcggcatcgccatacaggatgcctttctctgcggcgatttgcagctgccagccgatgcgctgttctgcaaaaaaagcagaccagcgccgtagccagctgttaggttgtggcgtggtcgtcaggttattgtcaaaatcaagaccgaactggggctgctcgctccactgatgcaggcgcgccagctgctgtcctaactgatgcgcgctgtgcgcgtcgagaggctcaggcttgatgtactccagcagaatgaaactgtaatcccgatcgctgccgacgccgtatacttccggcacgcggacggtctgcgttcggcgcagcagggcgagttgatcggcttcccaactgaaaagcgtcaccttgtcgcggctgttacattttacaaatacatcctggtcgccatagcgaatcagccaggcaggatgtacgtccccaccgggaagttcaagacgttgggtaatatcggcatgaccaaatggctcgtttaacagacgactaatggctgaccacatcgggttatcctctttattcgctgcctgagttcgattgtaacctgtaacctctctcgaaaatctgcgcttgcgcacagactattctggcgaacgggcagcgtcgcgcagaaaatcttcaagcgtggtcaacgtaacgtcgggtttctggcccagcgcgctttcgccagcggcaatggcttgctgttttaaatcttcgtgggtaagcgtggtgacaatgccaaaactgttggtgccaagctcgtgggggttccccttatcatccatcaacgtggtagagaagccgcctgatgtcagcgcgccggttagtgtcagaacgtcagcgagtccgctttcctgataatgaaacgtgacgacatagcggtgtaaatccccgttactcattttgcacctcgacatggttaaataacacacagcgtagtacatggtgaaaaaacaggcgaataatgaaggagatgagccttaaaatcagatcaatctgtgcgcaagtcacggcgggaatgcgaaagaaacccaatgtaaatcttgtaaatgaacagatgccatttggtaaaaatggctctataatgcgcgccgaaatcaggttaacgcccagtgaatgcacggcgttacgctaatgtatgccgttctgagcgaattcatgtttttttacaaaagttaccgtaaattgcattgatcgcattgggaaacccttcagaatcttcgtttttaaaactgccgcacggatcacatttaatgaaagcctttaacaagctgtctgctgttcttttgctctctgccggagcgttttgtcaccaggcgctggccgataatgctgtctttaccgcaatggatgacccatccacggctaaaaagccttttgaaggttctgcctctgcgggttacctggcacaaagtggtaacaccaccagttcatcattgaccgcacaaagcaatatgacctggtacacagaatcaatggcctacagcttgtggggcaatgccgcaaacacctctgctaacgatgagcgctcttctgaaacctataacgttggcgcacgttcccgttacaacatgagcgcctatgactatctgttcggtcaggcgagttggttaagcgaccgttacaacggctatgattcccgtgatgtgctgaccgccggttacggtcgtcagattctgaatggtccggtgcattcgctgcgtgctgaattcggtccgggcgtgcgttacgacgattaccgcggcggcgatcacaaaacccaaggcctggcctacggtgcggtaagctaccagtggcaactgaccgatacgaccaagtttattcagggcgtatctgtgctgagttcactgggcgaagataccacggtcaactcagaaaccggtttgcaggttgccatcaacgatcactttgccctgaaactggcttataacgtgacctggaacaacaacccaccggcttctgcgccagaccataccgatacccgaacctctgtcatgctgtcctacgcaatgtaatgcgcgttcacaatggctgatcaatcgcggtctggcagagtgcctggccgcttttttttgatctctctgagggttagcgtaaaacgcatgggttttgctcgcgcctgaaaactgctattatccgtaccgcattacactcctggcgacattccgacaatgtgggtctgatataccgccaggtcaataaaactactcaattttgtatgtaagctttcgtgtggcttaccactgcaactaaggacattctatgcctgtaattacgcttcctgatggcagtcagcgttcgtacgatcgccctgtcagcgttatggacatcgcgcttgatattggtcccggtctggcaaaagcctgtatcgctggacgggttaacggtgaactggttgatgcggttgatcccatcaccgaagacgcgtctgttgccattatcacagcaaaagacgaagcgggtcttgagattattcgccactcttgcgcgcatctgttaggccatgccattaagcaactgtggcccgatacgaaaatggcgattggtccagttatcgataacggcttctattatgacgtcgatattgatcgtaccctgacgcaggaagatatcgagctgctggaaaaacgcatgcatcagttggccgagaccaactacgatgtggtgaagaaaaaagtcagctggcaggaagcgcgtgatgtctttgctgcgcgcggtgaagtctataagaccaccatcctggatgagaacatcagtcatgatgatcgcccagggctctatcatcatgaagaatacgtcgatatgtgccgtggcccgcacgtgccgaatatgcgtttctgccatcatttcaaactgcagaaaatttcgggtgcttactggcgcggtgacagcgataacaaaatgctgcagcgtatctacggtacagcatgggcagacaagaaacagttggcagcttacctgcagcgtctggaagaggcggcgaagcgcgaccatcgtaagattggtaagcaactcgacctttaccatatgcaggaagaagcgccgggcatggttttctggcataatgacggctggactattttccgcgagctggaagtgttcgtccgtagtaagctaaaagagtaccagtatcaggaagttaaaggtccgtttatgatggatcgcgtcctgtgggaaaaaacgggtcactgggaaaactacaaagatgcgatgttcacgacctcatctgagaaccgtgagtactgcatcaaaccaatgaactgcccggggcatgtgcaaatttttaaccaggggttaaaatcctatcgcgatttgccgctgcgtatggctgagttcggtagctgccaccgtaatgaaccatcaggtgctttgcacggtctgatgcgtgttcgtggctttacccaggatgatgcccatattttctgtactgaagaccagctgcgtactgaagttaacagctgtatccgcatggtttacgacatgtacagcacctttggctttgaaaagatcgtggtgaaactgtccacgcgtcctgaaaagcgcatcggttctgatgaaacctgggatcgtgcagaagaagacctggctgcggcgctcaatgaaaacaacattgagtttgaatatcagccgggtgagggtgcgttttatggccctaaaattgaatttacactatacgattgccttgaccgtgcctggcagtgtggaacagttcagctagacttttccctgcctaaacgactggatgctacctacgtgggagaaaacaacgatcgtcagaccccggtgatgattcaccgtgcgattctgggatcgatggagcgcttcatcggtattttgaccgaagagttcgcgggtttcttcccaagctggctggcaccgatgcaggctgtggtaatgaatattaccgacggtcaggcagaatatgttgagactttgacacgtaaattgcagaatgctggcattcgtgtgaaagcagacttgagaaatgagaagataggctttaaaatccgcgagcacacattacgtcgcgtcccttatatgttggtctgcggtgataaagaggtggaagctggcaaagttgccgttcgcacccgccgtggtaaagaccttgggtcgatggatgtcgatgtgtttgttgagaagttgcaacaagaggttcgcagccgaaatcttcaacaattggaggaataaagtattaaaggcggaaaacgagtactacctacgcgtccgaacaaaattaacagtgaaatccgcgcgaccgaagtgcgcttaacaggcatggatggtgagccgattggcattgtcacattacgcgaagctttggaaaaagccgaggaagcgggtggcgacttagtcgaaattagcccgaacgccgaaccgccggtctgccgaattatggattacggcaagttcctctatgaaaaaagcaaatcttctaaggaacagaagaagaagcaaaaagttattcaggttaaggaaatcaaattccgtcctggaaccgatgatggcgactatcaggtcaaactacgcaacctgattcgctttctggaagatggcgataaagctaaaatcacgctccgtttccgcggtcgtgagatggcgcaccagcagatcggtatggaagtgcttaaccgcgtccgtaaagacctgtgtgaagatctggatttggccattgtcgaatccttcccttcgaagatcgaaggccgccagatgatcatggtgctcgctcctaagaagaaacagtaggcattcaagtagcaatggccgcgcagcgcttgcgttgcgcggtttgttgttcgcctgtctgggtcatgttatcaacaatgcgaagtggatatttttaaaaatgccaaagattaaaactgtacgtggcgcggctaagcgcttcaagaagaccgcttctggcggcttcaagcgtaaacacgcaaacctgcgtcatattctgactaaaaaatctactaagcgtaaacgtcacctgcgtccgaaaggcatggtgtctaaaggcgatctgggtctggttatcgcctgcctgccgtacgcataagtaaattttttaattaattcagaatattaaacaggagagctaaatggctcgtgtaaaacgtggtgtagttgctcgcgcacgtcacaaaaaaatcttaaaacaagctaaaggttactacggtgcacgttcacgtgtttaccgcgttgccttccaggctgttatcaaagctggtcagtatgcttaccgcgaccgtcgtcaacgtaagcgtcagttccgtcagctgtggatcgcgcgtatcaacgcagcggcgcgtcagaacggtatgtcttacagccgtttcatcaatggtctgaaaaaagcagccattgaaattgaccgtaaaatcctggccgacatcgccgtattcgacaaagtggcatttactgcactggtagaaaaagcgaaatcagcgctggcgtaagtcagttgaaaaagggagcttgctcccttttttattatctgtaacctgagcaaaagattgactttttcaccgctgcgcatttcaatagtgccgttgagaatcacgacaaggtaacgcaagcatgaatgctgctattttccgtttctttttttactttagcgcctgacaatcaggggcttttgcgcataagaaaagaaacgaaaaatcgcgctgaaagcctcccacgtggaggctttttttgtttttggcgctggcatattggaccgccaggtcccaacacgtactaaccagcctgactggaaaaagaggaaaacatgtcccaactagcagaactggtggcgaacgccacggcggccatcgatggggcgaccgatatcgccgcccttgacgcggtgcgcgtcgaatatctggggaagaaagggcatctgacactgcagatgaccacactgcgcgagctgccagcggaagagcgtcctgccgcaggtgccgtgattaacgaagccaaacagcaggtaacggaacgcctgaacgcgcgtaaagaagagatggagtcagcggtgctcaacgcgcgtctggcggcagaaaccatcgacgtctccctgccgggacgtcgtatcgagaacggcggcctgcatccggttacccgtaccatcgatcgtattgaaaccttttttggcgaactgggctttgcggtcgttacggggccggaaattgaagacgattatcataacttcgatgcactcaatatcccaggccatcacccggcgcgcgccgatcatgacaccttctggttcgatgccacgcgtctgctgcgtacccaaacctctggcgtgcaaatccgtaccatgaagaaccagcagccaccgctgcgcattattgcaccgggccgagtttatcgtaacgactacgatcagacgcacacgccgatgttccatcaaatggaaggtctgatcgttgataaaaatatcaacttcaccaacctgaagggcacgctgcacgatttcctgaacaacttctttgaggaagacttgcagattcgtttccgtccttcctatttcccatttaccgaaccgtccgcggaagtggatgtcatgggtaaaaatggcaagtggctcgaagtgctgggttgcggcatggtacatccgaatgtcctgcgtaatgtcggtatcgatccggaaatctattcaggcttcgcctttggcatgggcatggagcgcctgaccatgctgcgctacggcgtgaccgatttgcgcgcattcttcgaaaatgatttacgttttctcaaacaatttaagtaagggcaggttatccaatgaaattcagtgaactctggttacgcgaatgggtaaatcccgcccttgacagtgcagccttatctgaacagatcaccatggccggcctggaagtggacggcgttgagccggtcgcgggcgcgtttcacggtgttgtggttggcgaggtcgtggagtgcggtcagcatcctaatgctgacaaactgcgcgtgaccaaaattaataccggcggcgatcgtctgctggatatcgtctgcggcgcaccaaactgccgtcagggcctgaaagttgcggtcgccaccgtgggtgctgtgctgccgggcgattttaaaattaaagcggccaagctgcgtggcgaaccgtcggaaggcatgctgtgttcgttctcggagctgggtatttccgacgatcacagtggcattatcgaattgcccgccgatgcaccggttggcacagatattcgtgactacctgcagctggacgacaacaccattgaaatcagcgtcacgcctaaccgcgccgactgcctgggaattattggtattgcccgtgatgtggcggtactgaacagcctgccgcttaacgcacctgccattgagccggttgcagcgacgatttctgatactgtcccgatcaatgtcgaggcgaacgcagcctgtccacgttatttaggccgggtcgttaaaggcattaacgttgccgctgccacaccgctgtggatgaaagagaaactgcgtcgttgtggtattcgctctatcgatccggtggtcgacatcactaactatgtattgcttgagctgggccagcccatgcacgctttcgatctcgaccgcattgacggcggaatcgtggtacgcatggcgaaagacggtgaagcactgacgttactggatggcaccgcggttaaactcagcagcgatacgctggttattgccgatcaccagaaagctctggcgatgggcggcattttcggcggtgaacattccggtgtaaacgcggaaacgcaaaatgttttactggagtgcgcctggtttgaacccctggcgattgcgggccgtgctcgtcgccatggcttacataccgatgcctcccatcgctacgagcgcggtgtggatgccgcgctgcagcataaggcgatggagcgcgccacccagttgctgctgaccatttgcggcggtgaagcggggccggttatcgatcagacgtcggcggacgcattaccacagcccgcgactatcacgctgcgtcgtgaaaagctggatcggttaattggtcatgtggtcagcgatgagcaggtaaccgacattttaacgcgcctgggctgtcaggtcagcgtaggtaacggtgaatggcgtgcagtggcaccgacctggcgcttcgatatggctatcgaagaagacctggtggaagagatcgcccgtatttatggttacaacaacatcccggatgtgcctgtccatgctggcctggtgatgacgaagcaccgtgaagcgaacctgtcgctgaagcgggcgaagatgctgctggtagacaaaggttatcaggaagcgatcacctacagcttcgtggacccgaaagtgcagcagttgctgcatccgggtgaagaggcactgctgctgccaagcccgatctccagcgatatgtccacgatgcgtctgtcactgtggaccggcttactcagcgcggtggtgtataaccagaaccgtcagcagagccgcgtgcgcctgtttgagagcggcctgcgctttgtgcctgatacgcaggcggatctcggtattcgccaggatttgatgctggcaggcgtgctgagtggcaaccgctatgaagaacattgggacctggcgcgccagaccgttgacttctatgatttgaaaggcgatttagagtcgctgctggatttaaccggcaagatgaatgtgattagcttccgcgctgaagcgaatccggcgttgcatcctggacaaagtgcggcaatttatttacacgatgaacgaatcggatttatcggagtggttcatcccgaacttgaacgtaagctggatctcaacggtcgtaccttagtctttgaactactttggaataaggtcgcagaccgcgtcctgcctgatgcgcaagagatttcacgcttcccggcaaaccgtcgtgatatcgctgttgttgtggccgaaaacgtgcctgcagcagatatcatcgcggagtgtaagaaagttggcgtaaatcaggtagttggcgtaaacttgtttgacgtgtaccgaggtaagggtgtttccgagggctataagagcctcgcaatcagcctgattttgcaggataccagccggacactcgaagaagaggagattgccgcgacggttgccaaatgcgttgcggcattaaaagagcgattccaggcaaccttgagggattgaacctatggcgcttacaaaagctgagatgtcagaatacctgtttgaaaaactcgggctgagcaaacgtgatgcaaaagagttagtggagttgtttttcgaagaggttcgccgcgctttggaaaatggagaacaggttaaactgtcggggtttggtaattttgacctgcgtgacaaaaaccaacgtccaggcagaaacccaaaaacgggagaggatattccaattactgcgcgtcgcgtagtgacattccgtccagggcagaagcttaaaagtcgcgttgagaacgccacaccaaaagacagtgactgatcccagtgttttaaaaaggccgcgcaagcggcctttttcatttcttttttttgcaatccttttacaatcaaccctctgttatcctggctaatccggcttatgtcccagcttgaacaacttgcgcttcaacgcgatcgtcgcagcaggacctggcttttgggtctgagtggcacgttgcttgtcttatttatgatcagcctgtgtgcgggtgaaagctggataagcccatcccagtggtttagcgacagcggcagactgttcgtcggtcagcttcgcctgccgcgcagccttgcggtcatactggttggcgcggcgctggcgctgagcggcgttgtcatgcaggcgctgtttactaatcccctggccgaaccggggctgcttggcgtctccaacggcgcgggcattggtctggtggcggcggtgctgtttggcggcggttcactctggagcctcagcgtttcggcgatggccggtgcgctggtgatcacgcttatcctgctgcactttgcccatcgtcacttatccgtcacgcgtttgctgcttactggcgtggcgctgggcattatctgcagcgccatcatgacctgggcggtgtatttcagcagcagcctcgacctgcgacagttaatgtactggatgatgggcggcttcagcggcatcgactggcgctatggctggatgatgctggcgctgctgccggttatcctggcgttaacctcggcggccagggtactcaacctgttagcgctgggggaaacctcagcccgccagttggggctgtccctgttttactggcgtaatttactggtattagcgatgggctggctggtcggggtcagcgttgcccttgccggggcaatcggctttgtcggtctggtgattccccatctgctgcggctggcaggcctgaacgatcaccgtgccttgttgccagcctccgcgctggcgggagccagcgtgttgcttggcgccgatattattgcccgcctggcgctggcttctgccgagttacctatcggtgtcgtcacggcaaccctgggcgcaccgctgtttatcgtactgttagtcaaatcgtcgcgtcagctttagctggcatacttgcattaaccacaggaactccgtatgagcatttatcaaactgaactggttacactggatggtgagaaaacctcgctgtcatcctggcagggacaggtgctgctggtcgttaacgtggcctcaaaatgcggcttaacgccacaatatgaagcgctggaaaacattcataaagcctggcatgagcaaggcttcagcgtgctgggtttcccctgcaaccagtttctggagcaggagccgggcagtagcgaagagatcaaaaccttttgcagcaccacgtatggtgtgacctttccgatgttcgaaaagtgtgacgttaatggtgagcatcgtcacccgctttatgcgcagctggtggcggcaaaacctgaggcggttcgcccggaagagagtggtttttatgagcgcatggaaagtaaaggacgtgcgcccaaagtcccaggcgatatcctgtggaacttcgaaaaattcctgattggtcgggatggcagtgtcattcagcgtttctctccggatatgtcaccagaagatccgattattctcgaaaccatcaagcaggcactggcaaaataaatgttgctgagcctggaaaatgcagccgttcccggacggctgcaaccggtaactggcaccctgcaggccgggcagtgggtgcatctggtggggccgaatggcgcagggaagagtactttgctctccgcgctggccggactggaacccgttaccggcaaggcgacgcttctgaataacccgctgtccagttggaaaggcccggcgctggccagggtgcgcagctggctgccccagcaacagttgcccccgggacagatgccggtttatcactatcttcgcctgcatctcccgtctcccgctttacctcacgacgctcggttagcctcaatactgtcgcggctgcaactggatgacaaattagcctggccattgacccggctctccggtggagagtggcagcgggtgcggattgctgcggtcatgatgcaaatcgatccgcagatcaacgcccatggtcagttgctgatcctggatgaacccatgacggcgctggatattgcgcagcagaaagcggtcgatgatctgattggtgaactctgccaggctggcgtttgcgtggtcgccagcagccacgaccttaaccacagtttatggcacgcaacgcaggtttggttgttacatcagggccaggtggtattacagggtgagccagcagacgtccttcggccggaacagctttcgcccctgtatggcattccgttccgccagttaatgttagacggtcggcctctgctgactgttttgccctgatacttgccacctggcgcgctttgccgctacagtaatttggttattatttagtaaggatgagctgtgatgcgcacggggttgctgttattcgttttgctgttggtgggctgtagccatcatgcgccgcccattaatggtcgcctctctgactccatcactgtaatagcgcaacttaacgatcaactgggtaactggcgaggaacgccttaccgttatggcgggatgagccgcggtggcgtggactgctctggctttgtttacctgacattccgcgataagtttgatctgcaactcccacgcaccaccgcggcacaaagcgacattgggacgcgcatcagcaaagatgacctcttgcccggtgacctggtgttcttcaaaaccggcagcggcgagaatggcttgcacgtaggcatttatgatacggataacgcgttcattcatgcctccaccagccagggggtgattcgctcttcgctggataatgtctactggcgaaaagtattttggcaggcgcgccgcatctaattttctgcctgcaagcccagcagatttgtaggggttaaatcagaaaaatagcggacctgaaaaattattactcattcggatttaacttactctttttatttataccgccggacctaagaatgtttttcatcgttaacagaattatttgggaatttatttggcttaaggtttatttttttagcctaacgataatgaagcgataaaaatatccatctcatcagtcctttgctactattgccagcctgtttttaatcatatacgatgcactatcgccacatattctggctgtaaaatgaaaattcacctatctgccgactatcagtcggaaatttggttttatgccgcctgctctcaggaagggcacttaaccgctattgagctggctacacagttcgtgcatgagagtgcgccgatcacgttgccgcaggatgtcctgttgcctcagcttgatgaaacacagcgcctgcgcctgctgcagcgtcagatttccctgctggaaaagcaccagacgtttttcgaaagccatcacctactggcttttatgcctgtggatgaaggcatggcgaacacccttcttgaaagtgagtttctgacccgtaaaataaaacagcttccttttttaatgctcgatatcagcgaaacgtttctctcgctaaatttgggaaaaaataatccattaatcgcggcattaaatcgtgagtttaaattgtccttgtcccactttggcgcagggaaatcatcgacaacagcggtttatgataatctgtttagctgcatcaggctggataaacactttattcacgccctttctaaacgtgcttcttttttaccatttatgcaaagcatcatcgataatttccggccccattgtgatcggatgattatttgcggtgtggatgatgaaatgttactggataaggtgagtcaactcagcaatgtccatctccagggcacgctgtttccggtcgtaaaatcagacgccttcgagaccttaatctactccgaacaattcctgcacacgccctgatacccgcacgactgtcgcctgtccaatcctggccatcaacgctacactgtgggttttatcacacgatacccggtgtcgttggggagaaataatggtctttgacaatagctggttccgtgagcttccgggcagctacaccgcgttacatcctacgccgcttgcaggcggtcgactgttgtaccacaacgcagccctggcgaatgagatggcgctggacagcgatctttttgccgggcaggggcatggcgtttggtatggcgccgcgctgttgcccggcatgcaaccgctggctcaggtttacagcgggcatcagtttggcgtctgggcaggtcaactgggcgatggccgcggtatgttactgggtgaacaatacctggacgacggccgccggctcgactggcatctgaaaggcgcagggctgacgccgtattcacgaatgggcgatggccgggctgttgtccggtcaacggtgcgcgagtttctggcttctgaggcgctgcatcatctgggcattcctaccacgcgcgcgctgagcgttgccatcagcgatgaacccgtttaccgcgaaaccgccgaacgcggcgcgatgttgatgcgcattgcaccaggccatctacgctttggtcattttgagcacttcttctatagccagcaacctgaacaggtcaggcagttggcggactatgccattcgtcatcactggccgcacctggtcgacgaagccgatcgttatcaactgtggttttccgatattgtgctgcgcaccgcacggctgattgctcagtggcaaagcgtgggcttcgctcatggtgtaatgaataccgataatatgtcgatcctcggtctgaccatcgactacggtccttacggattcctggatgactaccagccagactacatctgcaatcacagcgattatcaagggcgctacagcttcgaaaatcagcccatgattggtttgtggaatcttaatcgtctggcccatgcgttgtcagggttgctgacgactgaacagctccggcaggcgctgagcggttatgaaaatgagctgatgcgcgaatggggagagcggatgcgggcaaaactgggcttgctgacagcagatgccggcgataatgatattctgaccggtttgctcggcctgatgagtcaggaacgcagcgattatacgctgacgtttcgtttattgagtgagacccagcaggctgagagccgttcgccgctgcgagatgaattcatcgatcgtcccgcctttgaccgttggtatcagcattaccgtaaccgcttattgcaggagcaaatcggcgatgctgaacggcagcaggcgatgaaagcggccaatcccgccgtggtgctgcgtaactatcttgctcaacaggccatagacgaggcggaaaagggcgaaagcggggcactggcgcgtttacatcaggcgcttcaacagccttttagtgacgcgacggccgctgaatatcgtcaacggccgccggactggggcaaaacgctggaggtaagctgctccagctgatttacagacggtgagaaacggcgtccgctaacagcgcgagcacgtcttcgctgtcttgccagttcaggcagggatcggtgatcgactggccgtaggtcaggggttcaccgctcaccactttctgattgccttcctcgataaaactctcaatcatcacgccggcgaccgcacgcgaaccgcttttaatctgttcggcgacgtcgatggcgacgtcacgctggcggcgatgttgcttcaggcagttgccgtggctgaaatcgatgaccaactgtggcgacagaccgaattcatttaaacaggcagcggcgtcggctacgtcgctggcatgatagttgggctgcttaccgcctcgtaagatgacatggccatgcgggttaccgctggtctggtaaatggtcatctggccttccttatccggcgacagaaacatatggctggcacgggatgcacgaatggcatccacggcgatacgcacgtttccatccgtaccgtttttaaaaccgaccgggcaggagagcgccgacgccatttcacggtggatctggctttctgtggtgcgtgcaccaatggcgccccagctaatcaggtcggcaataaactggccgatcaccatatccaggaattcggtggcggtcggcaagcccagcgcgttgatatcaatcagaagcttgcgggcaatactgatgccgcgattcacatcaaagctgccgtccaggtcgggatcggatatcaggcctttccagccgaccaccgtacgcggtttttcgaaataggtgcgcatcacgatttccagccgatcctgataacgttcacgtagggcaactaaacgctgagcgtagtccagcgcggcgaccggatcatgcagggagcaggggccgatgacgaccagtaaacggggatcgtcgcctgtgaggatgcgggcaatacgtttgcgtgcggcggtgatgttgtcggccatggcaggtgaaagcggatgttctgctgccagactggcaggggaaatcaggctgccaatgcgcgccgtgcgcagttcgtcagttttattcatgttgttctctaagctttgtcttcgcagcggtgaaataccgggaagtgatgatggtcacaataaaccattagcctgtgaattcaagccacaacgtgacgatgcacggtaaaattgcggcagcggcgcgttacagccccgccgcctggggatcattaatacatgcggcgcgtcaggcccataatgtcgaggattttggtggcaatctcttccacggaataattggtactgttgagatagcgaatctggtgagtgcgaaacagcgcttcgacttcgcccacttcgagccgacactggcgcagagaagcataacgggtattttccgcacgttcctgtcggatagccgccaggcgttccgggtcgattgtcaggccaaacagtttgtgttgatgctgacgcagagccgggggcaatttcagattatccatgtcgtcggcgataaacggatagttagcagcacggataccaaactgcatcgccagatacaggctggttggcgttttgccacagcgggaaacgccaatcaggatcacctgcgcatcttccaggccgcgcagagagatgccgtcatcgtgcgccagggtgtaatcgatcgccgcgatacgggcgtcatatttacccagattgctggcatcaagcccgtgcgttcggtgcgcgaccggtgccggtgacaggcccagctcctgctgaagtggagcgaccagcgcctggacaatgtcctgacaaaagccttcactctgaacaatgatgtcgcgtacttcaggcgtcacaatggaaaaaaataccaacgggcgcacgccactttgctggtaaagcgcattgatttgcgccttaacggcctgcgcacgctgcacgttttcaacaaacggcagggtaacgctggtggtatttaccggaaactgagataacacggcgtggcccagcacttcggctgtaattgctgtgccgtcggaaatatagaaaacgcttctgtcagtggtcatgagtcgtgcctcgggcagagaagtcgtgataaaaattggatggttcagtcaatataaccatgccttcaggcgcaagtgtagctctctcattctgtgccagccgcttttcccttttcaccgtaaggctatctctgttcctgcctgcatatttcctcatctggtggcctttggcgataaacacgggcggcgcgtgttgcgcaacaacaaaagcggcatatgcgacggtaaaaataataagtgatttattatcaagatgttattgagaaacgattgctttgcgcaacgttgcaaaaaaccaggcgcaattctgaaactgcctcagagaatctgctttaacgattcaacagatcgtgtttcgtcagacgttatgccaggctgaatgtgttaatagcaggattttccatgtgcccattcattaataaaggatcagttcaatgtccaataaaggcgaacagcccttagtactttggtacaaccagcttggcatgcatgatgttgatcgggtggggggcaaaaatgcctctctgggtgagatgattaccaatttgtcatctttaggtgtgtcagtaccgaatggttttgccaccacgtcctgggcctttaatcagtttcttgagcagagcggtctgaaccagcgtatctatgctttgctggatgacaccaatattgatgatgttgatcaactggcgaaagcagggaaacaaatacgccagtgggtagtcgaaaccccattccagcctgaactcgaagccgccattcttgcggcgtatgaccaactctctgcggatgatgcagacgcgtccttcgccgtgcgttcatccgccaccgctgaagatatgcctgatgcgtccttcgccggacagcaggaaaccttcctgaacgtgcagggcattgagtcagtcatggtagcggtcaaacacgtttatgcctcgctgtttaatgaccgtgccatctcttaccgcgtccatcagggctacgatcatcgcggcgtggcgctgtcggcggggattcagcgcatggtgcggtctgacctggcctcatccggtgtgatgttcaccattgatacggaatcaggctttgatcaggtggtgtttattaccgccgcgctgggcctgggcgaaatggtggtgcagggagcggtgaatccggacgagttttatgtgcacaagccgacgctggccgcgaaacgtcctgccatcgtgcgtcgcaacatgggctcgaaaaaagtgcggatggtttacgccgactcacgggaacatggcgagcaggtgcgcattgaagacgttgcggaagccgagcgcgaccgtttctgtctgagcgatgccgaagttgaggcgctggcccatcaggcggtgctgattgagcaacactacaaacggccgatggatatcgagtgggctaaagacggccataccggcaagctgtttatcgtccaggcgcgccctgaaactgtgcgttccaatggtcaggtgatggagcgttacagcctgcaagggcagggtaatgtggtgattgaaggccgcgctatcggccaccgtattggtgctggtccggttaaggtcattcatgatatcagcgagatgaaccgcattgaaaaaggcgacgtgctggtgacggatatgaccgatcccgactgggaaccgatcatgaaaaaggcctcagccattgtgaccaatcgcggcggccgtacctgtcatgctgcgattatcgcgcgtgagctgggtattccagcggtggtgggatgcggcgatgccactgagcgcctcaaagaaggccacaacgtcaccgtttcctgtgcagaaggcgataccggctatgtctatgacgaactgctcgacttcgatgtcaccagttcgcaggtcgataccatgccggatttgccgcttaagatcatgatgaacgtgggtaacccggatcgcgcctttgatttcgcctgcctgcccaacgaaggtgtcgggctggcgcgtctggaatttatcatcaaccgcatgattggcgtgcaccccaaagcgttactggagtttgatcagcaaacccccgagttgcagaagcaaattcgtcagttgatgaaaggcttcgacgatccggttgagttctacattgctcgcctgaccgaagggatcgcgacgctgggcgcggctttcgcaccaaaacgggtgattgtgcgcctgtcggattttaaaactaatgaatacgccaatctggtgggtggggaacgttacgaaccggaagaagagaacccgatgctgggattccgtggcgcgggccgttacgtgtccgaaagcttccgcgactgttttgcgctggagtgcgaagcggtgaagcgggtacgaaacgagatgggactgaccaacgtcgagatcatggtgccgtttgtacgtacggtcgatcaggctcaggcggtggtagaggagttaggtcgccaggggctgaagcgcggagagaacgggcttaaggtcattatgatgtgtgaaataccgtcgaatgcgctgttggccgagcagttcttacaacactttgacggtttctccattggatctaatgacatgactcagctggcgctggggctggatcgcgattccggggtcgtctcagccttgtttgatgaacggaatgaggcggtaaaagcgttgctgtccatggcgattcaggcggcgaaaaaacaggggaaatacgttgggatatgtggtcagggaccttccgaccatcaggattttgctgcctggttaatggagcagggcattgacagcctgtcactgaatccggataccgttgttgaaacctggttaagcctggcggccctgaacaaaaccgcctgacgttattagtaagattattgcctgaaggccagcgaatgctggcctttttggtttcacttttcgacaggcaaaaaaaagcccatcacaggggatgggcaaagactacacacagcaattctttacgctactcaggggaaattagggtgtttagaaaccagtaaattgatttccaacataggaaatatgttattcacacggctcgctggcgtctttaagaatcctcttattagtttaaaagaaataatattttgacgactggctagagcgttccggaccgttattatgtttagaaagtaatcattttagcgtgaggaatgggccagagacgtgaaatatgcgttttatcttaaaatctgctaatgaaaaaatggctggcgatatcttaatcagccagccaacttaacgactactaatcatataaaatcaagaatcagggctgttcttccggtgattcctttgcgacccgcaggggatcggcgctcggggcaggcacttcatgcatccagacggagaccagtcgataagaaacggccagcacaaccggtccaataaacagaccaatcataccgaaggcgattaatcccccgatgacgccggacagaatcaaaatcagggggagatccgcgcccatacgaatcagcaccggacgcagaatgttatccagcgtaccgaccacgcaactccagatcagcagtaccgtgccccaggtggtatctccactccagtagagataaataatggcgggaaccagcaccagcagaggaccgatttgcaccaggcaacagagaatcatcaacacggtcagcagggtggcataggggatgccagagactgccagcccgatgccgcccagtacgccctgtaccagcgcggtaacgaccacgccgagcgcgacggctcgtacggcctgtccggccagcaaaaccgcggcatcaccccgtctgcccgccatgcgccaggcaaaatgacggatacccagcgccgcttgctcaccgcgccagtacagcagcacgctgaacagcagcatcacggccagatgaatcataaagcggccaaagtgtccggcctgcgcaacaaagaagccggtggtgcggcccacatagggctgcagttttgccatgatggccgcgccgccgcccgccaccagtttttggtaactggcatacagcttctcgcccaccatgggaatatcgttaagccagctcagggttggcaacatatgtccctgggttgcccaggcgataaccggtgcgctgttatcgatcaggctgttaaccagcagggcaaccggaataataaacaacagcagcagcagaatggtcataacaatcaccgccagaaagcgctgtccccagagcagccgctgaattttcagcattagtggccaggtggcgatgaccaccatgcttgcccaggcaaaacccaatatgaacggctgaaccacccataaacaggcggcgattaagagtaaaatgaacatcaacgtgaataacatctggggaagatctatctgccgttccaggcttttcatcttaggcattacctcattggaatccgtcaactcaggggataacggtgccccataatcatgagccatttcatggcgtttatacaggcttgtaaagaaatggtttcagcttcccctgaaaaaacgacagcgccgttggaaatgtgataaaactgaggcgtaaagcaagatacagacgcaaacctacccaacatctttggtcacataataatgatcccacagatttctcaggcaccgggtcttatccagcgggtgctgacatttcttgaaaccctcaaagcgcagggtttcactggcgataccgccaccagttacgccgacagactttcgctttccaccgacaacagcatctatcagcttctgcccgatgcggtgcttttcccgcgttccactgcagatgttgccctgatagcccggcttgcgggtgaagcgcccttttcaggcctggtctttaccccgcgcggcggtggcactggcaccaacggccagtcgctgaatcagggcattattgtcgacatgtcgcgccacatgaaccgcatcctggagatcaataccgaacagggatgggtacgcgttgaagccggcgtggttaaagaccagcttaatgcttacctgaaaccttttggcttcttcttttcgccagagttatcgaccagtaaccgagccacgctcggcgggatgattaacaccgatgcatccgggcagggttcgctggtctacggcaaaacctctgaccatgttttgggcctgcgggccgtgctgctcggcggggatattctggatacccgaccggtacccaccgcgctggccgagcatctggcgcaaacgccaacccccggaaggccggatttatcagcaggtactgagtcgttgccgtgagcatcgcgaactgattctggaaaagtttcccaaacttaaccgtttcctgaccggttacgatctgcgccatgtgtttagcgatgatatgcagacctttgacctgacgcggctgttatgtggcgcggaagggacgctggcgtttatcactgaagcccgtctggatattacgcctctgcccaaggtgcggcgcatcgtcaatatcaagtatgacgctttcgattccgcgctacgtaacgcgccgctgatggtagaagcccaggcactgtcggtagaaacggttgactccaaagtcctgaatctggcgcgggaagacattgtctggcattccgttcgcgagctgattacggatattccggataaagagatgctggggctgaatattgtggagtttgccggagatgatgccccgcagatcgatcggcaaatgacgcagctttgtgcccgtctggataccttaatggcagcgcagcagggcggcgttatcggctaccagctctgtgacgatcttgatgggatcgagcgcatctacaacatgcgtaaaaaagccgtgggcttacttggcaatgccaaagggcgtgccaagccgatcccgtttgttgaagacacggccgttccacctgaacatcttgccgattatatcgtcgagttccgtgcgcttctggacagcaatggcctgagttatggcatgtttggtcatgtagatgccggcgtgcttcacgtccgcccggcgctggatatgtgcgatcctcatcaggaaatgatgatgaagcaaatttccgatgaggtggttgccttaaccgcacgctatggtggcctgctttggggcgaacatggcaagggcttccgcgcagagtacagcccggccttttttggtgaaacgctgtttaatgagctgcgccgcatcaaagccgtcttcgatcccgataaccgacttaatcccggcaagatttgtacaccgttcgacagcgatgcggcaatgatgcaggtcgatgcgaccaagcgtggcagctacgatcgccagattccccttcaggtgcgtgaaacctggcgtggcgcgctggagtgtaatggcaacggactatgctttaattttgatgcccgcagcccgatgtgcccctccatgaaaatcacccgtaaccgcattcactcgcccaaagggcgcgcgaccttaacgcgggaatggctgcgtttactggcggaacagggggttgatccgctgatgctggagaaaaagctgccggaaaacaccctgtcgctccgcgcgctgataagcagaatgcgcaacacctggtatgcgaacaaaggggaatatgacttttcacatgaggtgaaggaggcgatgtcaggttgcctggcctgtaaagcctgttccacccagtgcccgattaagattgacgtcccggattttcgttcccgctttttacagctctaccatacgcgctatctgcgcccgctcagcgaccacctggtcgcagcggtcgaaagctatgcgccactcatggcaaaagcgccgggcgtgtttaacttttttctgaagcagccctgggcctcttccttcagtaaaacgcacatcggcatggtcgacttgccgttactgtcatcgccgacgctcaagcagcagttgagcgggcacccggccatgaatatgacgctggagcagcttgaagcgctcagtgacacacagcgagccaaaaaagtgctggtggtgcaggacccctttaccagcttctatgaagccaggctggtgcacgattttattacgctgattgaaaaactgggttatcagccggttctgctgccgttcacgcctaacggcaaagcgcagcacgtgaaaggctttttacaacgctttgcccgcacggccagtaaaactgccgatttcctgaatcgtgtggcaaagctggggatgccgatggtggggatcgatccggcaacggtgctgtgttaccgcgatgagtatcgtcagacactgggcgaggcccgcggtgactttactgtgttactggtgcacgagtggctgcagaatgcgctgcaggaacgtgaggtacaggtcaccggcggggaatcatggtatctgtttgcccactgcacggaggtcacggcccttccggcaacgcccggtcagtggcaggcgattttctcgcgcttcggcgcaaagctcgaaaacattaacgtgggctgctgcggaatggcaggcacctatggtcacgaaagccagaatctggagaattcgctggggatttatgcgctgtcatggcatccacagttgcaaaaactgccgcgtcaacgctgtctggcaaccggtttttcctgccgcagtcaggtcaaacgggtagagggcaacgggatgcgtcatccgcttcaggcactgcttgaattagtgtaaaacgggtaggcgacgccgatcgcaggttggattagaatatccagcctgcgtgacggacaaattcacgctgcaacagggtggcctgttcccattcaccgcagcgggcaagctggtggcacagctgcgtcagagacagccttgccagttggtaagcctgaagacgaaacaggcgatcgcggtcggggttttgcatttcgtccaccagtcggtggtgaagtttgcccatcgcatgcagataactctggtcatcgccatttagctggcagatctctgccatatccaggcaggtatcattaaactgacgcagttgctgaagggtacattcagcccggttaagtttggcctgagccaggtagaaatcgacggtgagatcgcgtaccgaaaatcggtattcatcaagtttatgctgaagccaggcggaaacggataacgacataacgcgcctcaatattgaatgataatgattatcatattcatccaaagcgggattgcaatcacccgggaagaaatttttttcgatttatctcacctgtcggtataatcggaaataacaatctatttacaatgcagaaaggcgtaacctatcaataagggcgttatcctaaagtggttatttaaaaattcacgaattattaacaggttacagcaccgtatttcgtccagcgcttgcctctgcaagcctgcctgaaacggctatgcttaataaatgcgctgtcaaaaacagcaccttatgattatccctgcaaaacaagaggttgaagtgatttgtcagatcactaccatagggggatagcctgaaaaggtccggactcaagaggtatcaacatgtcatccgtgaatgcagactctttctcacccgacgattatgtgtggaaagggttaacgctgactgaaaccgcagcgaaacaaattctaaatctggccgcagaaaacccagaagtcaagggcctgcgtttagcaattaaacaatccggctgtgccggttttggttatgtgatggatctggtgaagcagccagaagatgatgatctgcagttttcctactacggcgcaacgctgtttgtgccgcttcaggcaatgccatttatcgatggcaccgaagtggactatgtccgcgaaggcctgaatcagatttttaaattcaataaccctaaagctcagcacgcctgcgggtgcggtgaaagctttggcgtcgagtaagtgaaatatgtcacgacacagcgaaacatctgacgatgtacaaatgtgggaaggtaagctcaattacaaagagggcttctttacccaattgcaaaccgaagaatttgccaacggcatcaatgaagatgtggtgcgggcaatttcggctaagcgtaacgagccagagtggatgctggagtttcgtcttaaagcctttcgtgcctggctggaaatggaagagccacactggctgaaagcccattacgaaaagcttgattatcaggattacagctactattccgcgccatcgtgcggaaactgcgatgacacctgcgcctccgaacccggcgcgactcaggcatccggtagcgcatctgccagtgattatctgacgcaggaagttgagaacgcgtttaatcagttaggcgttccggtacgtgaaggcaaagaagtggcggttgacgccatttttgactccgtctccgtgtcgaccacctatcgtggcaagctggcagagcaggggattatcttctgttcgtttggcgaagccatccacgatcatcccgaactggtgaaaaagtatctgggtaccgtggtgccacccaacgacaacttctttgctgcactgaactctgccgtggcgtctgacggtaccttcgtctacatcccgaaaggggtgcgttgcccgatggagctgtcgacctatttccgtatcaacgccgcgaaaaccggtcagtttgaacgtacgattctgattgcagatgaagacagctacgtcagctatatcgaaggctgctctgcgcccgtgcgtgatacttaccagcttcatgcggcggtggtcgaggtcattattcataagaacgcggaagtaaaatattccaccgttcagaactggttcccgggtggcgaaggcgagggcggtattctcaacttcgtgaccaagcgcgcgctttgcgaaggtgactacagcaaaatgtcatggacccagtcggaaaccggctcggccattacctggaaatacccaagctgtattctgcgtggcgataactcggtgggcgaattttactcggtggcactgaccagcggccgccagcaggcggacaccggtaccaagatgatccacatcggcaaaaacaccaggtcgaccatcatctctaaaggtatctcagccgggaaaagccagaacacctaccgtggcctggtgaaaatcatgcccacggcaaccaacgcacgtaactttacccagtgtgattccatgctgattggcccggattgcggtgcgcataccttcccgtatgttgaaacccgtaacaataccgcccagctggagcacgaagcgaccacctcacgtatcggcgaagatcagatgttctactgtctgcaacgtggcatcagtgaagaagatgctatctcaatgatcgtgaacggtttctgtaaagacgtattctctgagctgccgctggaatttgcagtggaagcacaaaaactgttagccatcagccttgagcacagtgtgggctgattgacgccgtcacacgcgttgccggaagcaatgtgaaggaataagcatgttaagtatcaaagatttacaggttagcgttgaagacaaagcgattttacgtggtctgaaccttgagattaaacccggtgaagttcacgccatcatgggaccaaacggttcgggtaaaagtacgctgtctgcgaccctagccggccgtgaagactatgaagtgaccggcggttcagtcacctttaagggcaaagacctgctggagctggaacctgaggaacgtgcaggcgaaggcatctttatggctttccagtacccggttgaaattcccggcgtcagcaaccagtttttcctgcagacctccgtgaatgcggtgcgcaaatatcgtcagcaggacgagctggatcgctttgatttccaggacttcattgaagaaaaaattgatctgctgcagatgccagaagatttgctgacgcgttccgttaacgttggcttctccggtggcgagaagaaacgtaacgatatcctgcagatggccgcactggaacccgatctgtgcattctcgatgaaaccgactctggtctggatatcgatgccctgaaaatcgtggccaacggcgtaaacagcctgcgcaacgaaaagcgtgcattcattatcgtgacgcactaccagcgtattctggattacatcaagccagacttcgtgcacgtgttgtatcagggcaaaatcataaaatctggcgacttctcgctggtgaaacagttggaggagcagggctatggctggcttaccgacgaagagtgattctgcgctgcaacagtggcaccacctgtttgaatcacgcggtgaaatgcgttcaatgcaggctcagcaacactggcagcagctaatgcgtttgggtttgcccacccgcaaacatgaaaactggaaatacaccccgctggatggcctgctggcggagcactttgtgttgcctgacgcgcatgaactcagcgcctcgcaggttgacgacctggccctggcgctggatgcgatccgtctggtgtttgttgacggtaaattccagcctgcgctgagtacgcgtgatactgaactgtttgagattcagcacagcgtagcggccgagcgtcgtgatttacctgcggctgttcagccagaaattttcctgcatctgaccgaaagcctggctgaagaagtgacctgtattcgcctggcgcgcggaaaggcagcagcacgtccgctttatctgctgcacatcaccagcggcaaagacgacggcatgaataccgtgcatcatcgtcaccatctgcaactggaagagagcgctgaagctgaagtgatcgagcactttgtgacgctgaacgacagcgcgcatttcaccggtgcccgttttacgtttgccgtcgcggacaatgccaggctcaagcacaccaagctggcctttgagagcaccaaaagctatcactttgcccataacgacatcgtcattaatcgtgatgcgcaagtcaccagtaccagcttcttactgggtgccggcttaagccgtcacaataccagtacgcagctcaatggtgaaaatactcagctgtccctgaacagcctggtgctgccggtgaatcaggaagtggcggatacccgcacctatcttgaacacaacaaaggccactgcctgagtcgtcagatgcacaaaaccatcgtgcgtgataaagggcgtgccgtatttaacggccatatcaaagtggctcagcatgcactgaaaacagacggacagatgaccaataacaacctgttattaggccgtctggcagaagtcgacaccaaaccgcagctggaaatttatgcggatgatgtgaagtgcagccacggcgcgaccgtgggccgtattgatgacgaacagatgttctatctgcgctcgcgcggtattgatcaggacgcggcgcaaaccatgatcattcatgcctttgctgccgagttgaccgaaacgctggaaaacccggtgctacgacaggctgtgctgcagcgcattgcgcagcgctttccaggagacgactcatgatgcacttcgatctcgagcgtatcagggcggatttccccgttctgaagcgtgaggtcaacggtcatccgctggcctaccttgacagcgcggccagcgcacagcgccctttgtcggtcatcaatgccgaaagtcatttttaccagcacggctatgcggccgtgcaccgtggtatccatacgctcagccagcaggcgaccagcgacatggaaaacgttcgcgaacaggcggcacgttttctcaatgcatcgtcgtcggaagagatcgtctttgtaaagggtacgacggaaggcatcaacctggtcgcgaacagctggggcggcagtcagctccagcctggtgataatctgatcatcacccagatggaacaccacgcgaatatcgtgccctggcagatggtggcagagcgctgtggagcagagatccgggtactgccgctcactgacaacggtgagctggccctggcgcaactggctggattaattgacagccggacccggctgctggcggttacgcacgtttcaaacgtgctgggcaccgtaaacccggttaaagctatcgttgcgcaggcgaaggccgctggtctggtcacgctcattgatggcgctcaggccgtgatgcatgacaaggtcgacgtgcaggatatcgactgcgacttctatgtcttttccgcccataagctctatggcccaaatggtattggcgtgctttatggtcgtaaggcccttctggatgcgatgccaccctgggaaggcgggggatcgatgattggtgaagtgctgctgcccaccggcaccacatggaataccgcgccctggcgttttgaagccggtacgccaaacaccggcggaatcatcgggctgggtgcggcgctggactacgtgcaggcgctgggtctggataccattcatcagcgcgaaacggccctgatgaactatgcccttgataaactctcatccgtgcctgatattcagatatacggtccgcagcagcgcgcaggcgtgattgcctttaaccttggcaaacaccacgcgtttgacgtcggcagcttccttgatcagtacggtattgcgattcgtaccggacatcattgtgctatgccgctactgcgccactatcaggtcccggcgatgtgccgcgcgtcgttcaccttttataacagtgaagaagaggtcgatcgcctggcggctgggttgacgcgtattcatcgtctgctgggcggttgagcagagtaaacggagtgattaatggcgacgttgccagaaaaagagaaactggtgcgcaacttcaatcgttgcgccaactgggaagagaagtatctgtacatcattgagttgggtgccaaactcccggaatcatctgaaacactgcaccagcctgaacatgccattaccggctgtcagagccaggtgtggatcaaaatgacgccgcaggcagatggcaccatcggctttgaaggtgacagtgatgcagctattgttaagggattgatagctatcgtatttagtctctatcaaaatctgcaacccgctgagatcgtggcactggatgttcgccactggttcggcgaactggcccttgttcagcacctcacgccaacgcgttcgcaggggctggaagcgatgattaaggcaattcgccataccgctcagaacctcagctaagatacactctaaagacgccatccggcgtctttttactatctgacgagaaaaccgcatgaaacctgctttgtgtttagccggtgcattgctgctgacctgttttgggctctctgcacccgtttttgccacggaatacccgttaccgccacctgacagtcgcctgataggtgaaaatgtcctgacgcaggtgccggataacaaacgcccgctggaagacattgctgcgcgctaccaggtgggcttgctggggatgttagaagcgaatcccggcaccgatccctggttaccgaagccgggcacccaactcaccattccgctacaaatgattttgccggatacgccgcgcgaaggcatcgtggttaacatggccgaactgcgtttgtactactatccgaaaggcgaaaacaaagtcatcgtgtatcccattggcattggccagttagggataatgacgcccatcatggtgaccagtatcagtcagaaaatccccaatcccacctggacgccaacggcgaatatccgcaagcgttacgccaaagagggcatcacgctgcccgccgtgttcccggcaggcccggataaccctatggggctgcatgcgctgcgtatggcccgtggtacggggcagtaccttatccacggcaccaacgcgaactttggtatcggtatgcgcgtgagttcaggatgcattcgcttacgtactgaggatatcgaggcgctctataatgcagtgccggttggcacgcgggtacaaattatcaatcagccggtgaaatacagcgttgaacccgatggtaaacgttatgtcgaggtgcatcagccgctgtcgcacagtgagaaggatgatccgcaaaccgcgccaatcgcgctcagtggtggcttcaggacgtttatgaaaagcgagcagagtgacggggcattgatcaaagccaccctgacgcgtcgctcagggatgcctgtactggtcagtgcgggagagccggtgcagaatgaggctgcggtcttatcgtcgccctgagacggctggagaggggagcgcgcgagccttgaccgctgaatagcaggcaaaaaaaatggtgccacaagggcaccatttttaaaaccagaactcttacttacggtaagagtgagcctggttgtccagacgctggttagcgcgagctgcgtcgtctttagcagcctgaacgtcagaacgcactgcgttcacgtcgttgctcagctggtcaactttagcgttcagagtctgaacgtctgaagacagctggtcgattttagcgttgcttgagcaaccagccagcagagttgaacccagaattaccgcgcccagtaccagtttagtacgattcattatttataccctctagattgagttaatctccatgtagcgttacaagtattacacaaagctttttaacttgagaataattttttgataagaacatgcttaaacatgatcgttcgctcaaagaaacagcgaattgaagatgaacgtaaaaaaatttagctaaaacagagagatttaatcggattaaccttaattttaagggcatttttattgtgactttaggctgaggttttccagaatcgcaattgtttagccaataaaaaagcgccttttaaggcgctttttaaaaaagaggcgttaaatgcgctattacagaacgtgcaccgacgccgtattggtggttccgcttgggaccagcgcaccggaaaccagcaccacaacatcacctttctgagcgaaaccgctttccagcgccgcttgtttacccagatgatagaaatcatcggtagaggcgatttcgctgaccatacgtgtctcaatacctttgctcagaatcaactggcgggccgtggtggcattggtcgtcaatgccaggatggttgcgttcgggaagtacttacgcacggccttggctgatttaccgccttccgttgcgacgacaatcaggggcgcttccagtttttccgctgtctcaacggcaccacggcagacagcttcagtaatgcgcagcttacggctgtcattctgaccgtcgatacgcggcttcatcacacgatcggtgcgttcacagatagtggccataatggttaccgattccagcggatagcgacctttagcactctctccggaaagcataacggcatcagtaccatcaaggatggcgttagccacgtcgccggcttcagcgcgggttggacgtgggttcttaatcatcgaatccaacatctgtgtcgcggtgatcacgactttacgggccttattacattttttgatcatcatcttctgcgcgaagatcacttcttcaaccgggatttccacgcccagatcgccacgcgcaaccatgatgccgtcagaggcttcgaggatttcatcgaagttattcaggccttcctggttttcaatcttagagatgatttgaatgtgttcgccgccgtgctgcttcaggtgctcacggatttccagcacgtctgaacgtttacggatgaacgacgccgcgacaaaatcaacgccttgctcgcatccaaaaatcaggtcgcgtttgtctttttccgccagcgcaggcaactgaatagaaacgccaggcaggttaacgcctttgttttcgcccagatcgccgttgttgaggacttcacagacgacgctgttctcagtgacttcggtgacctgcatgccgatcagaccatcatcgaccagcacggtgttaccgattttgagatcgttggcaaaacctgagtaggtaacggcaacgcgctcgctgttaccaatcacgctctggtcggtagtaaaggtaaaggtttgaccggctttcagggacacatcgttgccaccttccagcttcatggtgcggatttccgggcctttcgtatccaacagaatagccgcaggaataccggtttttttcgtcacggcacgcatgttagtaatacgctggccgtgttctgcatagtcaccgtgagagaagttaagacgcataacgttcatgcctgcttcaagcagctgggtcagcatctcttcggattcggtttttggaccgatagtacaaacgatcttagtctttttcatgacgggttatctgtaagttgtgatggatgagaaacaggatttcgatgacagcgcaccgaaatgagaactctgattgaaagcgataagggcggtacaagataagaataggtgacgaaggccaggcgtgcagggaagttgcgtggttagccgggttaaccaccgtgacgttgttgcgcaaacaatcttagttatcgtcataagcacgtagtcgctgaaacctttcaagtaaacaacgccgccagtataatcactaagtatgcgaaaaccaatcgaaaaacagtcactaaaggtaatgtaaatcaagaaaggggttgttgcgcaaaagaagaaaggacataaataaaagagtggtgcgctctaatggactcgaaccatcgacccccaccatgtcaaggtggtgctctaaccaactgagctaagagcgcatatcaaatttggtgcgtccgagtggactcgaaccaccgacccccaccatgtcaaggtggtgctctaaccaactgagctacggacgcacttggtgcgctctaatggactcgaaccatcgacccccaccatgtcaaggtggtgctctaaccaactgagctaagagcgcaacatgctgtcagggcgacagcggggacgaatattaacggcagcgtaagaggctggcaaggagaaaaatacaaatttgccaatgaatgaacatcatctgcacgatgcgccgtttttttgaacgtaacgggccttttccggcccgttcagtcagttagcgagacgcgcgtgtcaggatcaacgccgcaggtaattgctgtaaacgtcgtacccgccacagcatcatcacggcggccgaggtcaggccaacgataaacccgcaccagaaccccgccggccccatgcgcgggacaacccagtcggtcaacgccaggatgtaacccgacggcagacccagcagccagtaggcaataaaggtgataaagaaaatcgaacgggtatctttatagccacgtaaaattccgctgccaatgacctgaatagaatctgaaatctgataaatggccgccagcagcatgagttgcgcagccagcgtcaccacggcgggattgtcgttgtaaagcagggcgatttgatggcgaaacgtcacggtaaagatcgccgtgatcaccgccatgccgacaccgacgccttgcgcggtccaggccgccacgcgcgcctgctctgtcgaaccctgacccagacgataacccacgcgaatggtggcggccacgcccaacgacagcggcagcacgaacatcaacgagctaaagttcagggcaatctggtgcccggcaacgttcacaatgcctagcggcgacactaacaacgccaccacagcaaacagggtcacttcaaaaaacagtgccagggcgaccggcaaacctaatcctgtaagacgttgcaggatagcgcgtgagggtgccgaccagcggctctccacgcggatgtcccgcatgctgcgcatccgccgtacccaaaagcgcatacagaaaaacatcgcccagtagaccgaagcggttgctacgccacagcccacgccgcccagtgccggcatgccgaagtgaccgtagataaagatatagttcagcgggatattcagcatcagcccaagaaaacccagcaccatagcgggtttggttttggatagcccttcgcactggttacgcatgacctggaaaaacaggtaacccggcgcaccaaacagcagggcatgcagatagccttcggctttctccgccagtagcggatcgatgtcatgcatggagcggataaaatacccggcgttccacagcaccagcatgatgagcagcgagaggaaaaacgccagccaaaagccctgacgaagctgttcagcgattcgctcgcggcgacctgaaccattgagttgcgcaatggtgggcgtcaatgccagtaaaacaccatgaccaaacaggatggcgggaagccaaatggacgtgccaacagcgacggcggccatatccgtggcgctgactgcgccggccataatggtatctacaaatcccatcgcggtttgcgccacctgagccaggataacggggatcgcgagggccagcaattgacgcgcttctgttaaatacttctgcacgtaaacacctgacttgtctgattaataaagaaatgaggaatgcttcagcggaagcaagccctagtgtaactggcgcgactgatttctccaatctttgtcacgcaatgcggtttcatcctttgcggcctgtcactcaggctgttgaaacctaacacttaagcagggctgtggtaaactgacacaaacttcgcagaggcaaagactatgtttaccggtattgtgcagggcaccgcagaaatcgtgtccattgaagataaaggtctgttccgtactcacgttgtgagacttcccgccgaactgctgccgggcttagcgttgggcgcatccgtcgcccataacggctgctgtctgaccgtaaccgacattaatggcgatcgggttagttttgatctgattaaagaaacattgcgcgtgaccaatcttggcgacctgagtcagggcgatgtggtgaatatcgagcgtgcggctaaatttagcgatgaaatcggaggacacctgatgtccggtcatatcatgaccacggccgaaatctgcaaaattatccgttctgaaaacaaccgtgaaatctggtttaagatccaggatgccgcgcagatgaagtacatcctgcacaagggatttgtgggcattgatggcatcagcctgaccgtgggtgatgtgacgaaaaccaaattctgcgttcatttgatccccgagacactggagcgaacaacgctgggtgccaaaaccttcggcgaccgggtcaatatcgaaatcgatccccacacccaggcgatagtcgatacggttgaacgtgttctggcgcagcgtgaaaacgccgcagtgaaggcgctggccgatcaggccgatcagcccgacgaggaacgggatgaatagcagccgctaagccgtttgcggcatacggtcagtgacccgatgatggaccgacaaaagccgtctttcgggacggctaacttatggacatgccaaccataaggcggtgccgggagacggaaacggtatgtttaccgtcgcccggcagcggtttgtcgtcgccgtcgtcctgaacgcgatggccgaggcacccggtaaaccgatgaacaggtatgaccgggccgctcgcggcacctgcccacaacctcaccgcattcgccgcagtccgcctttatcggtcctagcgggcaacacgcaatccgccttcgacgccacgactaaacacgatctgccagagctgaatctcacgcgcgcgaaacgcccccgcgcaggcgttcaggtaatacgagaacatccgccggaaacgttcttcatagcgttcagccagcgctggccaggcgcgctggaaacgttcatgccaggccatcagggttgtatcgtagtcgacgccaaagttatgccagtcttccatgataaaatgcggttcgctgacgtcggcgatatggcgcaaagaaggcaggcagccgttagggaaaatatacttcccgatccacgggtcaacatgcatatcggttttgatcgcgccaatcgtgtgcagcaggaagatgccgtcaggtttaaggttgcgatcgaccgttgcaaaatacgtggggtaatttttcgggccgacatgttcgaacatgcccaccgacacgatgcggtcaaactgttgatttaaatcccgataatcctgcagcaggatggtaacatccaacccttcacagcgctgttgcgccagcttttgctgctctgcagaaatggtcacgccctgtacgctgacgccataattcttcgccgcaaaggccgccagaccgccccagccacagccaatatccagcagcgtcataccgggtttcaacgccagtttgcggcaaatcatatccagttttgcttcctgcgccgcttcaagcgtggtggcgtctttccagtagccgcaggaatattgcatgtagggatcgagcatcagggtaaaaagatcgttaccaaggtcataatgggctttgcccacctgccaggcacgtttttttgactgcaggttaatcagacgcgccagcgcaatgcgggcgatatcctggatgtgatgggggagttgttcatccagtttatgtttcagcgcccgatgaaaaaacatatccagccgttcgcactcccaccagccatccatataactctcgcccagcccgagagagcctttttgcaggacgcgtttgaaaaaatcgggatgtttaacctgaatatcccacggacgcgaaccgttaatgtcgatatctgctttttgcagtaactcatgaacgatgcggtaccaatggtttcgttcaatatccacttctgctacacatgatgaactcatagccactccatcaccagaactgtcagaacctgaggaagagcaggagccgtttctcagggttatgagaaaagtcacagatgacgccttgcgccagacaacaaaagagtacagagaaatgacatcaaaccgatgtccgcagagggcattgcccacaccgacaccgtcacagcaacgacgctgcgattcactatttattatgatgatactgcgagtcagggcccggcacaggaggcgctggcgggcccatcacgtgttgatcactgcgacgacagaaagtcgttgcctcagtgattatcctggcagggatgcgccgcggaggcaatatcagtttgtgcgcagacgcggcgctggaactgatagcccatcagcgccagtataatcgttatcgccataatgagcgtggtggtcaacagcgcgtggctcagtcccgccgatacggccaggctggcgacaaaacacaggccaagctgcaatgtgttttgcagggcggcggctttgccagtggcatgcgggaacgggagaagggcactggacaccacgatgggataaatcgcgccattagccattgccatgccgcaaaacggcaccagcaaagcggccagcgaaacgctgcctgagagtgcgacggcgaacagcgccagcacgctcaggctgtagacgagcagcagccacggcagtagccgagcgccgttaaaacggttaagcagcgcgcggcagccaaaaccaccgattaaaaaggcaatcgtctgcgggatgtaacttaagccaatatcggcgggcgacaggccaatatccgccaggataaacggcgatccggtcagccaggcaaaaaaactggcggaacaggcagaatagatcagcacgttgccgctataggcgcgtgaacgcagcagcgtcataaacccgggctgtgagggtgttgcacggcttgttttttgcaccgaaggcaggcgcagcgtaattataatcagggctgccgcgataaaggtcagcacaacgaaaatcgaacgccagtgaaaatggccaatcagccaggcacccagcaaaggggccaacgcaggagacaacgcgaccagcggcataatggtggcaaagactttattggcacgggacggaggatagcgatcgaccaccagtgcctgccaactgacggcggccgcgcacacgccaatggcctggataaagcgcagcaccagcatcagcaccacatcctccacccatagcatccctgcgcaacccagggcaaacaagctcagaccggcaagcaataccggtttacgcccaatacggtcagacagcgggccccataccagttgaccgcaggcaaaacccgccagaaacaggctcatgctggcgctgatcatacccgcagaggtgttgaaactttgctgcatagccccgaaggcaggcagatacatgtcggtcgccagaaagcccagcatactgagcacggcaagatagggaatgaatccttttgaagctgacatctgattctcttttttgcaggataaacgcgggggagtgtaaaagctgtacttcatgctgtgaaacggtaaaatttgcctgttgctgttaaaaaatttgaaggcagaatatgtggtctgaatatgcgcttgaagtggtcgatgccgtcgcgcgcggtggcagtttcagtgccgccgcacaggagttgcaccgtgtgccttctgctatcagctataccgtccgccagcttgaaacctggctggccgtgccgctgtttgaacgtcagcaccgtgaggtggttttaacccctgcgggagaacattttgtgcgcgaagggcgcagcgtcatcaaaaaaatggatgccacccggcggcagtgccagcagttagccaatggctggcgcggtcagataggcatagccgtcgactgtattgtcaaaccgcagcggacccggcaatttgtcagggatttctatcgccactttcccgatatggagctgcacatcagttatgaagtgtttaacggtgtctgggatgcgttggcagacggacgggtcgatgtggcgataggggcaacgcaggctattccggtgggcggtcggtttgcgtttcgcgatatgggcaccctgaactggcgctgtattgtcgcgcgacagcatccgttaactcaggtgagcagactggatgatgatgcgttgcgcaactggccgtcgctggtgctggaagacacctcgcgtgctttgccgcgccgcatgacctgggcgctggataatcaacgtcggctggtggtgcctgaatggcagaccgggctggactgcgttcgtgccggactctgcgtggcgatggtgcccgggcatttagcccggccgctgctggatagcggcgaggtgagcgaacttgccttgcctcaggcttttcctgaaagcccttgctgcgtcagctgggcggaagatcgcgcatcaccggcattgggctggcttctcaattacctgggtgatgcgcaaacgctaaatcaggagtggttaagcgaggattaacggcggtaatcgcggtaagggccatagcccacagagcgtcgctcaatcagcgtcgggtggacttcgatagtttgtgactcttcgcgcttgctggtgatgcggtccagcagcatctccagcgctttctcgcctaactgcgctttgggctgatgtacggttgtcagtgcgggcgtgaagtagcgcgcattgcgcacgttgtcgtaaccaatcaccgaaatatcctggggaacgcgcaggcccatttcatctgccgcacagatagcgcccatggccataatatcgcctccgcagaagacggcactgggccgttgtttttgcgacaggatttgctgcatagcctgataaccggattctggttcaaagtcaccctgcacaatccattctgaacggggctgaataccagcttcttccagcgccttaaggaaacccgcatgacgaccgccgccggtattacgctccatctgccccggaatcgcgccaatgtcacgatgcccgcgctcaatcaaatagcgaccggccaggtagccgccctgaaaagcgttatccagtacggtatcggtaaagtcggcacgtgattcgccccagtccatgactaccataggaatattgcggttggcttccagcatttgcagcaaatcatccggatactccgaacacatcaccagcagcccatcaacgcgtttttgcgccatcatcgacagataggcgcgctgtttttgcaggtcgttatgcgcgttacccagaatcagggtatagcctttttcaaagcagtgattctcaacggcttcgataatttcggcgaagtagggcgcttcgctggacgtcgctaacaagcccagcgttttggtgtgattcaccttcaggctgcgtgccacggcgcttggcgaataatgtaattcccgaatcgcttcccatactgcttcgcgagtattttccgcaacaaagcgggttttattaatcacgtgagaaacggttgtggtggacacacctgcgcgtttcgccacatctttaattgttgccatgaaaatcaaactcccgggcttacctaacatgttgataagcatgttgttaaacgtttgcgtcagcggacggttatttctgcaaaaaaagcgtttttctggccggtaatgggatatcggggcaggaaataacgtctgaaaaaagtgctggtgcaaccgatgttgcgcgctgttgcgcaacaaaggggggattctaacaaggctgcacggataaaacgagatttttacccgcgcgtatgggaaaatcccttaaccctacaaaacgcatggctaaggagttgtgatgagtaccgatttgaaactgtcattaatgacaacggcagcagcactgttgatgattatcgcgtttagctttaccgctattctgaactaataaaaaagccgggaaggtttccctttcccggctttttaaataatgacgtttagcgaacggtttttggcgtcataacccgacgcgcaccaatgtagtggcgctgccaataatcttcgcttaacgcactgatttgaatatctttaccggtgcgcggtgactgaataaatttaccgttgcccaggtaaaccccaacgtgatcggcggtgcctcgtccattaatgcggaagaacaccagatcgcctttctccagcgcttcacgattcaccggcgcagcatcacgcagatgatacatttcgttagcggtacgtgggattttaaacttcacgacatctttgtacgcgtaccagaccaggccgctgcaatcaaaaccggtatggggtgatttaccgccccactgatagcgcttacccagttggcccatcagcttcgccatcgcggtttcacgcgctttttgataacgctggcggtgtgcactgctcattttgatggtgccggtttctttgctgtcggcactggccactttcaccgcacgttgatgaccgtaacgttttttactggtggcgttggccgcgactttcttcgttagcgccttacgtgaactcgctgttttggtgagggttttatgagagggaaccgtgtgagtggcatttttactggttttaagtgttttactggctttttgcactgtagagggacggctctttttcgccgaggctttaaccgtgcgtcgtttgcgccgctcatcttcgcgcgcactttttttctctaccttatgcaagctggccttaaccggcgcctgcggtgatgccgcggcgacattaaagaacagttgcgcaaaagccagaataagaagcgtaataattgaacgcatagtccgtttactggttaagctgtcagatccaacaggtgtctgacaagggtaagaaaaatctgatcaaggatcagtgccgaggacattctagtccagttttttttaaaacagtaagtcctttttttattaattaatgacttgggtaaaaatcaggcataaataagcaatttcagtagcttaagtcagcaaaattattgcaaattattaatgagttcattccggctatcattcttgtcccgggagtaaacccccagcagacttaacaaacatggcgatttacccctggccggcacaaaatctcgttttcagtcctggagggaagtcgctacaataaagaaacacgaagtgacgaattaaggaaggcaataatgagtactgtagaaaaaattcagcgccagatcgcagaaaacccgatcctgctgtacatgaaaggttcgccgaaactgccaagctgcggtttctctgctcaggcggttcaggcgctgtcagcctgtggtgagcgcttcgcttacgtggatattctgcagaacccggatattcgcgcagagctgccaaaatttgccaactggccaacctttccgcagttgtgggtggatggtgaactggtcggcggctgcgacattattgttgagatgttccagcgcggcgaactgcagccgctggtgaaagaaaccgctgagaagtttaaagaagcggaataacaaaaaaggccgacatcgtcggccttttcttttgactggattttactccgccgtctctttcccttccgttgcctcttcagcgatggccaatggccagccacctaaacgcttccagcggtttaccagttcgcaaaacagcgtagccgtctgctgcgtatcataaagggcagagtgcgcctgactgctgtcaaattccattcccgctgctttacaggctttcgccagtaccgtctgacctagcaccagtccgcttaacgctgcggtatcaaaggtggcaaaagggtgaaacgggttacgtttcaggctggcacgctcggccgcggcattaataaaattaagatcaaaagtcgcattgtgcgccaccataatcgcgcggttgcaatcgttgtctttaatgcctttgcgcaccatcttaaaaatggcgtgcagcgcatcgtattcacttaccgcaccccgcaatggattgctgggatcaatgcccgtaaaggcgagcgcttccggatgcagcagggagccaacaaaaggttcaacgtgaaaatgcagtgtctggtcgtgaagaagccaaccctcgtcatccattttcagcgtaatggcggcgacttccagcagcgcatcggtttgcgcattaaagcccgccgtttccacatcgataaccacgggatagaaaccacgaaagcgttgattaagtgcgttgggggaagacgattcagacatcaggatctcattgcagaaaaagggcaacgcgtagtatgccaaaaaagcgcaccgtctgcagcaggtagagagaggggaaacgagaatcagcccgcgtggcgcgggctgatattgtacggcttaacttctgaggccgtgtccagcatgtttattttcgatcagttcgattttataaccatcgggatcttcaacgaaggcaatcactgtggtgccgcctttaaccgggccggcttcacgcgtgacgttaccgccgtctttacggatgcgctcgcaggtggcggcaacatcgtcaacgcccagtgcaatatggccataggcattgccaaggtcatagctgtcaacgccccagttataggtcagctcaatgacagcaccttcgctctcttcggtgtagccaacaaacgccagggtatatttatattcagcgttttcgctttgacgcagcaggcgcatgcccagcacacgagtgtagaaatcaatggagcgttgcaaatcgccaacgcgcagcatggtgtgaagtaaacgcatagcttcctctttttaaaacgtcattcccggatgacacaactactaagtatagcgacgataaccgtgaaagaataaccgcagccgtgagaacgtctcacggctgcatgcatgttacagggcaggataatcagtatagccttctgcgccgccgccgtagaatgactctgggcgttgtggattgagcggggcatctttttgtaaccgctgcgccagatccgggttcgcaatatagtcacgaccaaaggcaacggcatcgatcaagccacggctgatgaggtcatcggctttttcgacggtataagcgccagcgccaatgatcacgccagggaaggtgtcacgcactttctgacggaatgcatcgctgtaaggtgtaccacctgcccagtcaggttctgacatgtgcagataagcgatgttgcgtttcgccagttcagcgatataccacagcgcatcttcttcttcgttcgggccgttatccagattctggaagctgccgacaggggagacacggatacctacgcggtctgctgaccagttggcaatcgcggcatcaaccacttccagcgcaaaacgtccgcgtttttcaacgctgccgccgtattcatcggtgcgcagattagatgacggagacaggaactggtgcatcagatagccatgggctgagtgcagctccagcatgtcaaagtccgcttcgcgggcattggcggcagcctgaccgaaatcggccacgatctgctgaatttcgctgatgctcagttcgcgcggggttgacgtatcttcacgataaacgctgccgtcttcagcacgcagtgaggtgcgggtgcctgccggaatcgccgaaggcgcaaccggtgctttgccttctggctgcacgctgttatgcgaaatacggccggtgtgccacagctgcacggcactgtgtccgcctgcctgatggataccttcattgatggctttccacgcggcgatttgctgctgcgtgtgcaagcctggtgcgcccgcatagcctttggcctggaaagagatctgtgttgcttcggtaataattaagccagcacctgcgcgttgacggtagtattcagccatcagcggagtagggatatctcctggctcaatgctgcgtaagcgcgtcagtggtgccataaatacacggttaggaacggtaattgcgcccacttttaacggacgaaacaactgcgtactcgccataacaactcctttcaagtagaccggtcgtctacaaactgtggttttttataccagcggatttttcagccactgttcgagggtaataaatgcaagcctcatgggctgtgctttacgggaaagcttgctctgcaaactggcgccgagccacaacacatagagcagttcagccagttgctcgggtggatgaggcaattgcaatccttcatcctgctgtgccagtttgagcgcacgcgcatacgcggcaataacatgactggcaccttgctgcagggccatgcgcatgggctcagacaggtcacacacttcggctgacagttttacactcagacaaccgacgatatgcccctgttgttcaaagatttcaagcgcatgcctgaaatggcccagcaatcgttcactgaccttacccacggggtgagacagttgctgctcaacctcatgcaggtagcggataaagtagcgctccagcagggcgacgccaaaggcttctttagactggaaatagtaataaaacgatcccttcgggatggccgcctgagtcagcaactggttcaggcccatggcggtaaacccgcgctgcaggcaaagcgattcgcccgtagccagcaagtgttcccgtgtctcattacgttgtggcatcttattcatgggctttatcctggtagaccaatcggtctaatgcaaatcttaatcgcgtcgcaggcacagagtgctaaatcatcacggacgaaaagtgaataaatggcgcgtgcggtgattatttcttgcacaaatgcatcagtctgtcttcaatagaaggattaacgtttgagtgggagcagtcgtggcagagcagctagagttttttccggtgcccagtccatgccggagtatttgtcagacagatacacgcggctactgtgtggggtgcctgcgcagccgtgatgagcgttttaactggatgcgctacaccgacagccaaaagcgcgaggtgctgcgtctctgccaccagcgccgcctgcgccagctgcgccaacagcataaagacgatcctcaggaaccgcagcaacctaccttgttctgacccctgcgcgatttccgttatactccctaaccagccgctttttgtgccacagggagaacaccatgttacaaccgcaagccattgctccgcagggacccgacttttcaccgctcattatgggctattggcgtctgatggagtggggcatgacgcctcagcagctggtgggatttattgaacaccatctttcactgggggtttccacggtcgatcatgccgatatttatggtgactaccgctgtgaggcggcgtttggcgaagcgttaaaatgcgcgccggctttgcgccatcggctgcaaatcgtcaccaaatgcggcattgcaacccgggctaaaccagaacatcagattggtcattacgtgacggacaccgcgcacattcttgccagcgccgaacgttcacttcgctatttcaacaccgaccatatcgatctgttactgattcatcgccccgatccgctcatggacgccgacgaggtcgctgaggcatttcagcaactgcgccaggccggtaaggtactgcacttcggtgtatccaattttacgcctgcgcagtttgcgctgttacagtcgcggctgccctttagcctggtgactaaccaacttgaaatttcccccgttcagcaaaacgtcctgctggatggatcgctggaccactgccagcagcatcgcctgcgcccgatggcctggtcatgtctgggcggcggccgcctgtttagcgatccccatttccagcctttgcgcgacgaactggcgcaaatccgcgaggagacaggcgcatccagcctggaacaggtggtgtatgcgtgggttatgcgcttaccgagtaaacctttacctattattggatcgggcaaggcacatcgcgtcaccgaagcggcaggcgccgccgatctgtcgctcagtcgccagcagtggttccgcatccgtaaagctgccctgggctatgacgtaccctgagcgtaaacattcgtcaatttgcggcaatctttgcaggacggggccaggcttaagctgaaacccaaagcagaaaggagccacaatgaaaggtaaagccatcgcgttattaacactgttaacctgcggcgtcgcccaggccgcgagtgaagaggtgacgattcatgacgtgtcgccgcaggggatcggcaaatccgtggggacggtgaagatcgaagaaacgaagtatggtttaacgtttacgcccatgctgacagggctcaaaccgggcattcacggcttccatgttcatgccaaaggcagctgtgaacccggtgagtcagaggggaaaacggtagccgcaggggctgcggggggccatctggacccggaaaataccggtaaacacctcgggccttacggtgaagggcatttgggcgatctgcctgctctctatgtcgatgagcagggcaaggcaagctaccccgtgctggcaccacgcatcaaaaccctcagtgaggtgaaaggcaaagcgctgatgatccatgtcggtggcgataatcatgcagatcatccgaaaccgcttggcggcggcggtgcccggtttgcctgcggcgttatctgacgggccagtctggcggcgcaggtggccgccagcaatgcttttcgcttgttgaacatttgttgtagcatcatcgccttattcccccctatgatactgattcccgtcataaagcctgacaacctgaggagcaggacagatgaaatggaagggcgcatggttactgtgcttgctgctggcaggatgcgataaaccgaatgatacgcagttggtcaccgaaaccggacgtgaacttcagcgcaccattgataccaatcctgcgcgcattcggtgtgaacacatcgcgagagggcgtgagcggttgagtcgggatgtgatgcaaaaacttcaagacgcgcattgccagaatgttctgcgtagcgccactgagaccaatttcacggataccactatctatcatcataatgcggtgatgatttgtggggggattaccgggaaaagctttaccggcacctttatttcgcggcgctttattttctctcctgacgaaaaagcactggttattgagcccgtatcagaggcggataaaacccggtttgaaggacaaaaaaccgtgcagcagctgcaggatgattttaaccggcagcatcagcagtattgccagtaatcagtcgggaatcgcctgcttcagttgatccagcgaacagcgtaatcgccacagcaatcccgcaagcgtgctggcttcgcgggtattttcccgcagagtttcctcgatcatcgtctgtagcgcgtccagcgccgcatccagttgccggtgctgcacaccgcgaaggctcatcacgtgctgcagatcctgcatcgcgcgcacgcggcaggcattcagtctcgatgatccggtttgccagtcgcgcagctgccagacgagatgtgaacagttgagcaggaccacgccccagcgcagtaaccagacgcgcgccgtttcatcccgactgctgctgagttgaccaatcttatgatagatcagtgactcgaagcggttttcgctcaggtgaggtcggggacgaagctgatccagaaacgccatacgtaaagactgaatatggcgtcggctacggcggctgtctgaactgggccgaagtatctgaaacgccagccaggccagcagcacgccacacactttggcgatattaccgtcaaaaaacgtttggtaatcccagtcgggtgggttggtgacggccagaaacgatcccaggaaaacaataaactggccccacatggcggcccgctgtttctgttgcacccgaaacagttgcagagtcaacagcagcggaaataagatcgccagcagctgccacagctgatcaaactgcaccataagaccgaatttaaaaacaaagctaaacgcaaacagccacagcagcgttttcagtaataatgtgatactgcccgtgggcgagggcgccgaggcgtaaagcacgcaggcaattgccgtaaaggtcaatgccgacgcgccagaggaccattgcgtcgtcatccagaatgcgcagcccgcaaccaccacagtaaaggtgcgcagtgcactccagcccgcttccgcactgtcgctttcactggcgagcgccgacacggcgggtggctgaaagcgcctctccccatcggcgtgctccagcaaccgtatccagcgtaatacgttgagatacatccagcagaaatagcgcagccgctgacaaaaagcgcgttgccgatagtcgccgtcaccggctggcgtaatggtgcggagcagtgctgccaggcggtacttattacagtctggtttcgccagctcacgtgtgaggctctctaacgccacaaacaccgtctcaggcgcgtcgggccagttcagcagcatacgacgcaggctggacagtacgctggtcaaccgtaactgttgatgcaggatgtaattcagcacgttattttggcggcgaaagcggtaatgactccagaaggcctgaatgcgtaataaattcatggtgaggatctgcccaatcaccgcttcatgcgccgtgcgtatcccgtcattgcgggtgtcctgcagcagcagcgtggcgtgctccaacaggcgagtgtgcatctgttttagcgcgttgattaacgcatcgccgtcagaagtgctgggcaagagcatcatcataaagcccgcgcacagcagcccggaaatcacttcgcacacccgagcctgcgcgatgtcccacaggctggcgatatcggtgagattgacgcagctgaaggcaataatcgccgcggtataacctgccagcgaaaaaccgtacgccacgttgttctggtagtggtttgccacccaggtgcacagcgccagccagccggcaatataaaaggcgaacagccagggctcattcaacgtatggcccgcaatcaacagggcagccgtcgcacccaacacactgcccacaatgcgacccagacttttactgatcacaccgccgatggtcggaaagctgacaacggctgccgaggtcatggcccagtaaggctcatccagattcaggccataggcaatgctcagggcaagacacatcgcgctggcattacgaagggcatagcgccattgattgcgatccgccttcacccagggcaggtttccccaggccagtccattgagattcatggctgtatcgtaatcgtgcaggtcgtgccagcgattaaacgcgcgtgatcgggaagtgcggtgaggcgaatgcgaacagggacacgctgcgccaggcgaacccagggcacgttaggtttgatatccggcagtaaaccgttatccgcctccaggctttgatcgtaaatagcccgtcccacgctttcgacctggccgggcaactgcataccactgctgtacagtaccacctgggcagcggcgccgggatgaatatggcgcaacttggtctcttcaaaatagcccacaacataataagaatggctgtcgacaagggcaaagagcggcgtgcccgcgctggcgtagttaccgggtcgcagggtcagattacttatccaaccgtcagtgggggcagtaacggtggtttgctgcacattccactgcgcctgatcccgctgtgcctgcgcggctttcacgctggccagcgccgcatccgcattcaggcgagccacatccagatcttcgccagaaatcgtattgcgcggcagtttacttcgtctgctgaattcatgttgggctttggcgaggtcggcttttgcctggctgagttgcgcatcggctttgttcagttcgatctgccacggcaccgggtccagtgtgaataaggtgtctccctgatggacaaactggttatctgtcacttttagcgcaacgatgcgccctgatatctgtggtgtgatatccaccaactcggcacggacttttccatcccgtgtccagggtgactgcatgtagtaattccaggcccaccaggcgctgagcaacgcgatggtgaaaacaatcagcgtggagaagtactttaatccggaaaatgtcatctttttcatccgtgatccatcagccagagtgagccagttacgcacagcacgaacatggagagatcaaacagtgtgggatgccagacttcgccggaggcgagccagccgcgcagcagtgggtgaatcagcaaccagagaaaaaaaccggccagcaccgctttaaacaggggagggaagtaaagtgacgccccgaaaatcagttccgtgagcgggtgaacagtaagaaatccgtggttgatgatatccattatggtggtgcatcctggaaccggatggtgaaatattttcagccgaaactgttcacttagttatttgtaatttaaccttcaagcttgcaaaatactatacaatgccgcttgatagctagcatactaaattataaggagataacatggatacccctctcggaacggacctgtccagactggtacgcatctggcgcgcactgatagatcagcgcctgaaaccgctcgacctgactcaaacgcactgggtcacactgcacaatatccatcagcttccccctgagcagtcacaaattcagttagccaaagccattggcatcgagcaaccttcgctggtcagaaccttagatcaactggaagaaaaagggttaattacccgcaccacctgtgcgcacgatcgccgtgccaaacgcatcaaactgacgcagcaggcagagccggttattcagcaggttgaacacgtgattgatattacccgggatgacatcctctccggtatcagccgcgatgaaatcaatcagatggtgtcgctgattgcacgccttgagaagaatatcctcgagctacagaacaaagagaaataacaccgacgcgcagtgcggcagcactggcgtcggtaggttactgcgttagcgtggagaaacggtaacctggctgccgtcagtcgccattgccacacgttgtccgacggagtaacgactggccgcctgtttctgcaccaccatgatggtattgccgtcatccttgcggatttccagctcgacaccatcagatttattcatcgcaccttgtacgccctgacctgcaacgccacccagcaccgcaccgccggccgttgccagactgcgtcctgcgccaccgccgatggtgttgcctaagaagccacccagcaccgcaccgccgattgcgccgatgatgttactgtcatcgccgccctgaattttaaccggacgcacggacaccaacgtaccgtatgaaacactctgaacctgtttggcttcactggcgctgtaggtatcgcccgacaacgtatcggtattgctacaacctgcaagcattacaccagtcaaagcgaccacaattacacgcttaatcatttgaaaactcctttattcaagaatgcgccatatctctcgcgaaatcctgtaaacagtataagacataaagctggatagttgacctttgtcggaacaaaacatggctgacgccagcatagaccgttaaaatttaacaatgattcaatcgataacagaaaaagttcaaaggcgttaactgacaggcaattaattgattaaaaacaaattaatcatggatttagcggggagagtttgtcacgcttatacccgcgtaataacattttcaccacaacgaaaggaaaggctatgaaatcaggacgctacatcggcgtgatgtcgggtaccagccttgatggtgtggatgtggtgctggcagctatcgacgaaaatatggtggcgcagcaggcaagctactgccatcccatgccgcctgatttgcgtcaggcgattctggcgatatgtcaggggcaaaccctgacgttgtcacaattagggcaacttgatacgcgactggggcagttgtttgctgaagcggtactgaccctgatgcagcgagaatcccttgaggtgggcgatatcgtggccatcggctgccacggtcagaccgtgtggcatgagccgcagagcgcggcaccgaatacgctccagatcggtgaccacaatcagattgttgccgcgaccggtatcacggtggtgggtgacttcaggcggcgagacatggcgctgggtgggcagggtgccccgctggtgccggctttccatcaggccttgctgatggatgccactgaacgtcgcatggtgctgaatataggcgggatcgccaatctctctttgctgatcccgggacagcctgttcgggggtttgataccgggccgggcaatatgctgcttgatgcctggatctggcgcaatcagggtaaagcctatgataaagatgcccagtgggcacgcagtggccacgtcagtcatgctctgttggaggctttactgcgtgagccctggttagccttgccgccgccaaaaagtaccgggcgggagctgtttaatctgagttggctggaacaacacctgcgccatttccccggcatcgccgcacaggacgtccaggccacgctcaacgagtttactgccatcagcattgcgcaacaggtgcagctcaatgacgggtgcgatcgtttactggtctgtgggggcggcagccgcaatccattactgatgtcacgtctggcagcgcatcttgccggtaccgaggtgaccacgaccgattcggctggcattaacggtgatgatatggaagccctggcttttgcctggctggcatttcgcaccctgtcgggcctgcctgggaatttgccggcggtcaccggggcgcgtgccaaaagcgttatcggtgcaatctatcccgccaatccgttatatacgcgctaaaagaaaggggacagaagctgtccccttgaaagacgtggacgtagcggctcaggccaccccgggaagatgcgtcagattacgcacgcccgtgatgacggttgccacgatggtttcccgacgtgtaatgacttcgacctggtagtatttgctgcgataggcaattgaatagataaccggatggtatttattgccctcaccatagcgagacatatgggcttcaagcgcgcgcgaggcggctacgatatggacgggttctttatcaccgcggatgatttgcttcattcagtccctcaaatgctttacctgtggggcgcgcctgaacactgcgcgttgcatcggtctttaacactgaacatctgactgcttaacatcatcgttaatttaaaaaacagcgtgcacgttaaatattgcagagcaatgacacaatctgaaacgtgctactcatatttagcagcacgttttatttccggcaagggaaacgcaaaatttattacgttttcgtgctaagccttatttaagctcgggccaggcgacggcagagacaccgtttaacttaggccaggaaaaaagaaacccctggaactgtgaaatgccggcggcttccagccacatccactcttcaggttgttcaatcccttctgcaatgacgctaatttccagagacgaacaacaggctaaaatagcgtgcacaatcgcctgcttcggcccgctcttgtgcacgttactgataatgctgcggtcgatttttattttatcgggttgaatctgcgtcagtaatgacaacccggcatagcccgcgccaaaatcatccagcgcaacgctaataccggcggctttaagctgttttagcgcggcggcaaattcatcaaggcgtgagatgatttcattttcggtgaactcaaccacaatttgttcgggcaccagatcctgggcatgaatttccgccagcaaaaaagcgactgcatcgggcaccacgaccaacgacattggcagcaggttaactgacagcatgataccgtcgacgcccagtgcttttgcctgggcaaaggcggtgcgcttagagtgcaaatcgttgcggtagatatcctcgggtgcaaggcgcgaaaaataatgctgttgtgtttccccctgacggccgcgcagcagggcttcaagggaaacgattttacgggcaaagggatcaatgatcgcctgaaaggcaaaatttacgccctcctgatcgatcattgccgcatcaccttcgcgtgtttccgcatcatcctgaataaaatcccagctgtccgcagagggaatttcaaaataattttctttctctcgcgcttcaacaaacgtgcgtaagaacttaagcgcccgatcgtcgtacgtcagttgatatttagtcgtgcctttttccagcacggcattgagcactgtggttttatcgtattcccgcaggtcaaacagctccatgcccacgttaccaaaacgacgagaaggggcgtaatcacgcattaattccacaatattatgatggctggaatcgcggcaaatacgctcataaaccgccaggacatccgcttcaggtccttcaagcacctgaaaaaaatgggtaccgttaaataataaaatgccggttacactggatgtctcatttattttgttagctttagtgactaatccttccagcatcttaagcggaacgtggtcagcgatgtgactgcgatagataattgtagacagcataaagtcttccagattcttgtttttttaccgcacacattgccagagcgtttatcaggcagagcctgatcctgctgtcatatcatcgcaaaatgtgtctgtgccatgctcttcaccagcactgcaccagggggcgcttacctgtgatgttccgttgtcacagaagagttaacgcgatcaatccatggggtggataacagaccgggtcggcggtaaacagattttttattattctgttctttaccagcgtgttacgcatagtttctattatatcagtagttcagccgttaggtattgaatagtagtatcttttttgcattttatcgcccactaataaatccggctggcgcagtctgcgataaggttatctggcgtaatcaaattatccctttggccttacgtccatagccgggcagaaaatagcagcgtgttgatttgatatgtttttttaagcggtatgcacagtgacgggtttaaacgcaatgattaaaggatcagacctgatttggcgaacaatgccatttcctgaaacccgatgctcataagacgttaacctatgcgaaaccgcccactgcgaataaatctcaaaaccacggttttataattatctctgtagttttagggataattctcagctaaggtcaacaacgctacattattaaattaaatcgtaattaactctttttctacctcattggcacagcgaccaccaggggcaatcttatgcttaaatcaagctactattatgtctgtccttatacccgaggcggatggataattcataaagaaggttgtattcatctggataacggccgtggacgtgaatttattggttcgctgtatacccgtcagcaagccttaacggtggccaaaattcatcaccccgacgtcatcctgtgtaccgcctgcctgagcccgtacgtgtgccccagtgctggcagaagcctggcagcacgcagtcgggccatgcccatgcgtcatacgccaaagtcgtcctgaacggagtatgctgcgccagcgctgagcgtgcgtttcatcttgtcggcacaaggtgtcggaagggcgtgaaaaatcgggtcatgaaggcggggcgttcactgccgcgttaagagcgaataaccgctaaacacgcatcgtattaatagtgcagggcacgcagtgtaataaagcagctgcgaacagctgctttattcatattaagcctgtttaggctgtccgttagaagcggtcaggccaccatcaaccgggagattagcgcctgtaatataacgcgcgtcctcactggcaataaaggctattgcatcagcaatatcttcaggctcacccgcacgccttaacggaatgcgatcgtagaagcgctcaagcagcgcctgatcgtttttcacgccttcggtcagatcggtgaaagtgaagccgggacaaattgcatttacccgcacgccgtcagcgccgtaatccattgccagtgaccgggtaaagttggtcactgcgcctttggcggcgttgtacacgctcattccccagtcgccacccaaaccggataccgatgagatattcaccacgttgcctttggatttgagcagggcgggcatgaagaagtgaacgcagtggaatacgccgtcgagatcgacactcatcagcttcttccagtcggcaggttcgatctcatggatgcgcccctgcacgataatcccggcattattgaccagcacgtcaacccggccatatttctcttcgacgcgggctgccagggcttttacctgatcggcctcggcgacatcgcaggcggtagccagatgactgtcgccaggcaactgtgctaacactttttgcagcttatcctgatgacgtccaaccagtacgacagaggcgccttcctgtgcaaaacgcctggcactcgcttcaccaattcctgaaccggctcctgtcactacaacgattttacctgtaaatctggacattttgcctccttaatggcgtcgcttgctgttataaccctgttcagcctggcagccctgtggcccaggtcaagcgcaacgggaccggatgcgtattgtttaaccgctaagcgcccgaatcgcgttgcgcaggacgccgttacggccttctgaacagggccatgctccggccttccagctcaaagtccttctctttggtgatcaccattccgtgtttgctcacatcgctggtggtcagctccagtacccatccgccttccccaaactgaggaatacggaaggggacgttgccttcaaacgggttgatcagcatgagcacgtcataccagacaccgtcctgatgttgcaggtccgggcggccgatatagacaccgagcgttgagccttcgtcccactgttccgcctgctgtaatccaccaccggcattgaaccacttaatttccattccatcgcgccagctttcacgccgtaacagcggctgggttttacgcagcgagatgacgtggcgcgtgaactcacgcaaggcttcagcggaggcgggcaggttgtcccagtgaacccatgaaatttcactgtcctgacagtaaccgttgttgtttcccatctggctgcgaccaaactcatcgcccgccagcagcatcggtgtaccgtgcgagaaaaataacgtggcaagaaagttacgcttctgacgctcacgaaccgcattgataccctcgtcgtccgtggggccttcggcaccatagttatacgagcggttatcattgtggccgtcgttgttgtcctcaccgttatcggcattgtgcttctcgttgtaggacaccaggtcgttcagcgtgaagccatcatgcgcggtgataaagttgacgctggcccaggggcggcgtccgcgctggtcatagagatcgccggagccaagcaggcgcgcagcaaaatcggtggagacattgttccctttccagtaatcgcgcacggtatcgcgatactgatcgttccattctgcccagcccggtgggaagccgccgacctgataaccgccagggccgatgtcccagggctcaccaataagttttaaccgggagagcaacgggtcctgggtgatggcgtcgaagaagccgccacgtgggtcgaagccttccggttcgcggcccagaatggtgccaaggtcgaaacgaaaaccgtcgatatgcatggagtcggcccagtaacgcagggaatccgtgaccatctgcaacacgcgcggatgagaggtattcacggtgtttcctgtgccggtgtcgttgatgtagtaacgatgctggtccggcaaggtgcggtagtaagagaagttgtcgatgcctttaaaggacagggttgggccaagctcgttgccctcggcggtgtggttgtaaaccacgtcaaggatcacttcgatgcccgcatcatgaaaggcgcgcaccatatcccggaaaccctgaatgccgcgcggaccgaaatagcgcgtcgccggggcaaaaaagttcagcgaattatagccccagaagtttttcagccctttatccagcaagtgttgatcgtctggaaaccagtgcactggcaacagttcaaccgaggtaatgcccaggcttttgatatagcccaccgtcgatgaatggctcatcccatcgtaagtgccacgcatctccggcggcagcgccatgttcatttgggtgaagcccttcacatgggtttcataaacgatcgtttcggaccagggaacctgagggcggttttggtcctgccagtcaaattcattcgggtcaatcacgcggcatttcggcgtgaagggcgcgctgtcgcgatcgtcaaacgtcaggtctttgtcttcgtggtacagatcataagcgaagtgtgcctcgttccacgcaatatccccggccagttcgcgcgcatagggatcgaccagtaatttattcgggttaaaacgatgaccgttttccggatcgtaagggccataaacgcggtagccatacagggtgcctggcggtaaaccaggcacgtaaccatgccaaacctcatgggtaaactcaggcaaatccagtctggctatctcattttttccgcctggatcgtaaagacacagttctacgcgttctgcgtgggcagaaaacagcgcgaaatttacccctttaccatcaaagtttgccccaagctgtagactcgatcccgacgtgatttcaaaacgatgatttgacatctatccctctcaattaacgaacccagttacggcgtttcagtccatgtactgacctgctttcagcaagcgaataatgccagtgcccagtagttatttaacgtttcaagcgtaatgcgatcggtcagggtgatttcctggccacttaacacatcacggtaacggcgatgtgccagttcgtcaggcaacacaatctctgtggcggcccagcgcgccgacgggggcgtttccaggttttgctgtgggttaaacatcagccgggaggtgatcacgataacagcgtcattgccgcgcgtacgggcaaaggccagtagcctgtccgaatgcgcgccctgtgccgtcagcggcaggtaagcgcctcgggcgaacagttcaggccgatcccgacgggcattcagtagcgcaaccgtcgcttgctggttaacctgtccctgaagccagccatcaagcgtagcgggcagggcggtcgtcgcagccgctaacatctgttggagggcggcataatcaggctcacgacggttgtcaggatcgaccaggctgaagtccagtgcttcgcttccctgataaatatccggcacgccaggcgcggtcagcttgatgactctctggctcaggctgtttatcagcccggtctggataaagggctgcagcgcctcgacgaaatcctgcaggaaagcctgattagtcggtgaaagcagatgacgcgcgtagtccagcaccgcctgctcataggccgcattgttctctgtccagtcagtacgcagcttggcttcacgcagcgctttttccacatagcccgcaaagcgttcggctaaggcgtccagtcccgcgctatcctgagggtccagggtcggtggccagacgccagccagcgcctgatacagcatccactccacggacgcctccggcgcagggccatcctcaagggtacgtaccgcctgacgattaagcccgcgccagcgttccacgcacgtcgcccagcgctgaggggcttctgtcagggtgtaaaggcgggcacgtgcgtcctcgcctcgcttggtgtcatgcgtcgagctggcggtaagggcatccggctggcgcgcaagacgcgtttgcatctcatgatgaaactgttgcgggtcaaactgctgctgcaagggttctgcgccgacttcattaagcgccagcgcccggttctgtcggtagaacagcgtgtcctcgatggatttcgccatcagtgggccggtgagctgctggaagcgggtacggaagctgtccgccagtccggtgaccttagcgtcaacgttgccctgcataatctgtagcaggaaatcgagcgtgcggctgtccggcacctgtgctgacgccttcacgttgctggcgatatcctgtagccgttgcaggtcatctgcgggcaggccgtgcgcattcccgtaggtgcggtaaaccggaaaggccaccaacagctcacgcagtgcggcgcgcagctgatccgggttaaccgtcatctgttcacctgcggcaatagcggtagccagatccatcaggcgcgaaaattcacccgcaaagttgcggtctgccatcaggcatttcgcgttgcggagttcgtctgccatctggacggcggtgccactgacgctctcataggcctggcggagcccgtcgagatgatgattatcaaccaggacatgggacagcgcggcgataaactcgtagccggtggtgcccgaaatcggccagtcggcggggatctgttctccctcacccaggattttctcgacggtgatataacatgccgcaccggcatcgtggcgtagctgttcaaggtatccttttggatcggccagcccgtcaacgtgatcgacacgcaggccgtcaaccgcgccgctgtgcaccagttccagaataagccggtgcgcatccctgaacactgccggatcttccacccgcacaccgaccaggccagtaacctcaaagaaacggcggtaggagagatcctgggcggcatcgcgccacgacatcagtcgccagggttgctgttggtgcagggccgccagctcggctttgctgcgaagctggagaaccgcttcttcacgtccctgccagctttccggggtcaggggatagtagctctcaaaataggccagtgccggtttgccggtttgcggatcgcgtttgacggcgaggtctccgttttccagcacggtgtcgagatcatcgcccagaaacggcagcgtcaaacggcgtgaccagtcgatatcaaaatagtgggcatagcgactgttttggccgtgttccagcacgtcgtaccaccagccgttttccagcgatgccgccatgtggttgggaacgatatcaatgatgaatcccataccggcctgtttcaacgcctgcgccagacgatcaaaccccgcgcggccaccaatggccggatcgatctgattcacgtcggtcacgtcatacccgtgggtagattcacgggtcgcggtaaagactggcgaagcatagagatgactgatgccgatgtgtttcagataaggaatcagcgccgccgcgcggtcaaaggtcatgccatttcggaactgaatacggtaggtcgcggttggaatactcatttatgctctccggcagccagacgaacaatcattgcgtttggcggcagattgtctgccggttgcggccaggcaaaaagggtttcccccggcatctctggcaggggacgatcctgttcaccgatattcaatgccaaagagagggttccggctgggaacgtccagcttacggcaacgaatccctttgcggtttccagcaccttcccgctatgcccgcccgccgttgccagcagcggcacaatgtactgctgccggatggccagaagcgaacgggtcagcttcagccaacgttttccttcttcactttccagcttgcgccagtccagttttgatcgggtaaaggtcgcttcgtcattgggatcgggaacgctttcaccttcatggcccgcgtgtccttcaaactctctcgcccggccttctcgcaccgctttggccagatcgccatggaaatcggtaaagaacaggaaaggatgggtttcgccgtactcttcccccataaacagcaaagggatgtgaggcgacagcaggagcgtggccagcagcacctgggtacgttcggccccggccagcgaaatcagccgttctccctgcgcgcgattgccgacctgatcgtgattctggataaagtccacaaaggccaccgggggttgaccggtgctgtcaacgccgcgcttttcgccggactgcacggagacctcgccctgatagacaaagccctcagccagcgcgcgcgccacgcgtttctctggctgttcggcaaaatcctggtaataagcatgcgtttcgcccgtggcaaacacatgaacggcattgtgaaaatcatcattccattccccggtaaacagcggggcggagccatcttctgctctgggatgcagaaagataacgttgcgacagtcttcggtggtgaggtgaatctggcgatcgggaatatcggcacgaatgcgttcggcaatgtcagtcaaaacatgcttgtctgaaatgtcttcaatctggtcgatggcgtcaaagcgcaagccgtcaagatggtactcctgcagccagtagagcggggcttcggcgatataacgtcgcaccgcatccacatcataagcaatgcctgcgccccacggcgtcatccggtctttatgaaagaagtcaggcgacagcaacggcagatagttaccatccgggccaaagtggttaagcacaatatccagtaccaccgcaatgccataaccgtgggctgcatcaataaacgccttaaaatcgtcaggcgtaccgtacgctgcgtgaggtgcgtaaagcagcacgccatcgtaaccccaaccacgttgaccaccgaactgagagacgggcagcacttcaatcatggtgatgccggtttcagccaggtaaggcagtttctttatcgcggcctggaaggttccttcttcggtgaaggtgcccatatgcatttcatagaccacgctttcctgccacggacgaccttgccagttggtgttctgccaatgatagtgaccaggatcgatgaccagagaagggccgttgacgtcgtcttgctgcgcgcgtgaagccggatcgggaatcaccgtgccatcgttcagcacgaaattataggctgctcccgcctgtacaccgctgacctgctgctcaaaccagccgtcttcggctggcgtcatcgcgatatcattaccggaaagtcttaatgtgacctgctgttgacccgtcgcccacacgcggaaacgcacggtaccatcagccagaaattcacttccccaactcttaaaaaaagatgtagatcccattccgttgcctcgttaaccagaaagtacgcaataaacatcctcgcgctatcgttaagccgatgaggcgagttcaaaggtatgtcagcgagattcagcgcccaggaggtcggtacgccttaacagccttaaccagcgccattattcagaaaatgttatgtgtaataccgcttcaggcacccggcagcgcctgcttcacacgactctcaacaagtaatcatagactacgctgcggcatttacggtcgcggtgcacaatgaacagcgcaccttttttcccttctacatgacagagttgtccgatcaccccgacatccttctgcagctgtctgcggtaaatcagataaagaccagggcttttgcagtaaaaaaccgctgaaagcagcggttttgcagggaaaacagaaagggcaggtgtgacactcgcgcgccccgtgctccagccaccccaatcggaatggctggaaccaggatcaggccggaatggtctgtgctttttggctgcgcgaccagacgcgatgttctgccatggcggcggtaaaatcattcatcagcgcaatttcagcattatcggcttccacaatgccttcttcttgctggttttcatccagatcaaactgcgctttaaagcgacgtgcgtcgccactcaggccgatgactttcagatgcttgtaggcttccagcaggaagtagcgcgcgtcaccgcttttcagcagcgcgtcaatgttaccatcaggtaccattacggcatcgaaggtcagtgaagggagaccgttgaacgtcgcatcgatgggtaacagagaaccgtcgtcggcgctgacctggcccatatgcgctgccagcagtttagtatgcacgcctgcggctttcagatgctgcaggatgtgcaacacgtcctcagccttcacgccttcgctcaacagcagcgccacctgacgacctttgatgtcaccatccggaatcgcatacaggctcaggctgtcatctttctgcagaccattcacgtcttttggcgcagcggtattcagctgttcgtcgctaaggccaatacccagattggctgccacaccttgcgccagtttgacatcaatgcgcagcagatggtcaagcacgcgctcgcgaatataaggacgggcgactttactcagctcgaaagagtacgcgccaatgatgtgctgctgttcgatctcggtctgactgttccagaacaggcgaggttgagaataatattcgccaaaggatggactgcgttcacggactttatacccctcaacacgttcctgatagctctcgaaaccgccaccttttgccgcaggcggtgtttcgcgaggccagttatcgttaattgagttgggctcatagttggccggattggtgtcaatatccatccggtgcatgccctggcgctggaagttgtgatatggacaaaccgggcggttaatcgggatctcatggaagttaggaccaccgaggcgactgatttgcgtatcggtgtaggagaacagtcggccctgaagcagaggatcgttggaaaagtcgagcccaggtacgatatggcccgggtggaacgcaacctgctctgtttctgcaaagaagttatccggattgcgattcagcaccattttaccgacccgcatgacagggaccaacgcttcaggaatcagcttggtggcatccagaatatcgaagtcgaacttgaactcatcctcttccgggatcagctgcaggccaagctcgaattccggaaagtcacccgcttcaatcgcttcccacagatcgcgacggtggaagtccggatcgcgcccggtcagcttctgcgattcgtcccacagcagcgaggctttacctgccagtggtttccagtggaagcgaacaaacgtggctttgccttcatcgttaatcaggcggaaggtgtgaataccaaagccttccattgtgcgatagctgcgcggaataccgcggtcagacattgcccagatcacgttgtgcagggtttcaggttgtagcgacacataatcccaaaaggtgtcatgagcactttggccctgtggaatttcattgtgtggctcgggtttcaccgcatgcacaaagtcggggaatttgtgggcgtcctgaataaaaaacaccggcgtgttattacccactaagtcgaaaacgccttcatcggtgtagaacttggtggcaaagccacggatatcgcgcaccgtatccgctgaacccgcgccgccctgaaccgtggagaagcgcacaaacaccggcgtaatctgctctggctcgctcaggaaatgagctttggtcacgtccttcattgagcagtaaggttggaaatagccgtgtgccgccgagcctcgcgcatgaacgatacgttccggaattcgctcatggtcaaaatgggtgattttctcccgcatgatgaaatcttcaagcagcgtcggcccacgcgcaccggcgcgtaacgagttctggtcgtctgcaatacgggtgccctgattggtggtaagcgggctgcccgttccatctttacggttcgctgctagctgatcgagtttgctgctgtgagtatcgggggctttaagactgcctggtgccgtgggtttcttacccggcggtgtcggttcggctggtggctgatgtgaaccatctttaggagccagtgagcccagtccaggctgtgatgattccgggccggtcgtgggggcccgatgactcaggggattattctttttttcattcgacataacacattgctccagcttttttttactacttgaggtgccagtaaatatagaacaacttaattaataagcttataaatattgcgcttaatcgttgcggttaaataaagagcaggcgatatttctcctgtttttagtgattttcaatcagcgaaaaaataatttaatagcgaaactaaatgcttattttaagcgcgacggcaatgtggtatctctatcttattcaatgggttatttttttatttccctttgctgtagcctgggtgattacagccagttgttttttataaggcaggtattttctgaaaatcgttccgctcaggtttattacgttttgctaaaaataagcggcgttttttcctctcacgctacgcttattatcctcaaagcgaagcggaaataagcgacgatggataaggcgtaaaaagcattactggaaagggtgaacgggaataaaaatgcaggggtgagaggggataaaaatcgccagtccatggcgtactacctccttaaggcgccttactcagaactacttagaagtgcgacggctttttttgcctcctttccgaccggcctccctggctctttcaggatcgtttttgaaattacctccgctggctttgcctcctgcactgccagcttcactggctcggtctggatcgttggcaaaattaccggcaccacctctgtatttctgttgtgtcatagacaagacctcatatcagggttccttagataagaaggactagctagtcacagcgctaagtttagttctgatacgaaattatgccactctgaaacccattattcggtgacgagatgttgcggttattacttgtaaaatcagtggataagctgtgcgcgccggggacgcggggcaggtagcgcgcgttgccgttatacgcgacccgttacaacaaaggtattaatcagggattattcataaagttagcacttaacctattgatagtgctggccttaatggcgattttaaaattagctgttacactttctggatactgttcaggagtgtttatgaaattaggctttgcatgtaagtatttaaacgaagagggcaagcagtatttcccctttcgcgcgaccacgcgaacccgttttctcagcctggatgaggcgcaacgcacggcgctcatttatgagatttcgaagaccaatttgcagaacctgtatttaacgttggaagccattgcggtcctcccggacgcgttaagaatgatgcggattggcagcgatttactgccgttgtataccgtacctgaagcaaagccgttatttgcggcgtttctgcctgagctgtatccgttgtttgcccgctgcggtgagctggcgcgggcgcatcatatccggctgtcattccatccgggacagtacagcgtgctggcgtcggacaatcctgatgtcgtttcacgcgccttagaggatgtggaataccatgcgttgtgcgcctgtttgatggggtacggcaaaaccttccaggactttaaaatcaacattcatatgaatggcaaactcgggtttgacgggtttaaacaggcgtttcagcgcctcagtcctgaagcgcgcttgatgctgacggtagaaaacgacgaaatttcgtgttcactggacgatgtgttgcaggcaggggcgctgtgtccggtggtgctggatatccatcatcactgggtcaaagagaaccagtttatccgggcggacgatgcacgtattgcgcggattgttgattcctggcgcggcgtccgcccggtgctgcattactccatttcgcaagaggggattatccccaccgagggctttccggatcagcacgccctgaccgtgccgaaaacaaagcttcgtgcccattccgattactatttcaatcccacgctcaacgcctgggcattgtcattcagcgatttcgacatcatgtgtgaggtgaaaatgaaaaacctggcgcgtgagcagctgtacgattggggaagacgtcaaaacctgatcgcctgaggcgcgcaggcaaaaaaaagcccctgaatcaggggcaaatttttagggaaggtaaagcatccttgctaagtagcgtgtcatcatcacaacaaaattaaaaacgaacgtcgcccggcttacgctgaagaacgctctccagagcctgacgatagatatcctgtttggtcgcgtcggtttcactttccagtttatggatcaaacccagtaacatatctttttcagaaacgtgcgctttaaaagaagcgagttctgaccaggtctctgcaatcacatctttttcgctggtgaaagtgtcacccgcattcatgaaatattcagaaatctgagactcagtattcgttgtcgtttgcatggtagcctcaaaatcggaagaagacgttttcctgcccgtggcgaagaaaattttgcatctgaaggtggaaatccactcaccttcagatgcggtgcaaggcacctttcgttacaagtgatttaacatcacggcgtaaagttatacaaaaaaactaactttgtacaattttttgcgaagaaaaacttctggtcggatgagttactggccgagggtgcgctgctttatgctactgtttttgatatttaattatgatttataagggttttttctggtgttgcctgcgcctgtttttttcgtgcggttgtacaaggctgcgcaaacttgtacagcgtaagctgtataattctggtcaggaacgcacaaaaaagtcccggactgggcagggcacgcgtcgggttgggagcctttaagccggttgctactgtgctgcgggcgaccgcaacgtcgacatcatcgcatgacggcccgcgtgcagcgtatgaccattttcctgataacgatgccccggcagagaatagcaatcgatggtcagcggcacataaacgctcgaccggtcaggcccgcatttttgcgtcctgtggtcataaagcaggctttgtgggcggcggtgcaataattcacttccttctgtacccgcagggcgttaaggtttacgcctcttggatcagaaggaaatgataatggttaacgactatttttcgctgccgcctgcgggtatgacgcaggaacagcataaacgtacggtcgcggttgctgcggcactggcagtggcaaaagagtcagtcagcgcctcaacgtcagcaaatggctcgaaagcggcctgggatctgcaagcggtggcaaacgaaattgccaatctggccgatgcgattcaggatgcgctggagtctgacagcgacgtataacggtgagattgcgctgtctgatcgggcagcgcgacggtaaaaagcacgctcacgctcaataacaaggctgtctgtttcattctccgcccctgcgcagcccgctttcccaccatgtcccactgcgcagcgctatacagcctgtcatcccggtaacgtcaccaacaccgcttgccggttctacgcagccatcaggctttgacggcaccgatagcgttatcgctcagagcgctgctgagagaaataagccagcagacgggtcatcttttgctggggtgaggtgtaagtctcgtcagtgactttacctgtccagcgatcatctgcttcaggatgaggtccggttaacaccaccgtcccttttccgtaggcataacgcgccatcgccacatcaccattacgataaaaggccacaggggtaaaaccgtcctgcggcttatggccgacaagataagggccatcctgataatagaatgtctcttgtctgccattccacttaacaggaatcgtgtaatcaccctcatcggcgatcggcgatcccggacgtcctgcttcggaatcaagcggcgaggcgatcagccccagccagttactgtccgccagataagcacccatgcacagaccgaggtaacctttaccattgcggacaaaatcgcgtagggcttttgccccctcatcccccagggcttcataggccgctggaatatcctgacctccgccgggctggatataaagatcaacctgacgcaggttctgagcattcagtgtttgtttttcgttttcgccgatataagaaatgctgagcggcatcgcgacgccgtgtagcgctttcatcaccatttctgaacaaccttcacagcctgccgcaccacgataaatggcgattctcagtggatgattgtccgccaggctaaagccggacgcgaggctcaaggcaagtagcatcgcggttaacatcccacgaggatagcgaacacgttgtaatgcattaaaagccgggcgcatgatgcatttcctgtcatagcgagaaagaacgcttccgttgcggcacccacggcgcggcataagaagagaaggtcagcgcaggcagactggctggacgcgataaaaatagcgcatttcagtgtccttgagcaactgctcaattttgggtgacgatcattcctggccaaccctttccccgcagagagcgtccagcagagcgccgcctttgatgccgttgtttcctggactgcccgcttactggccgttattggctataacccgaagcgatgattttcgctgcgcccgccagaaccgctttgcgcgaagcggcatgtgggtcgggctgggtgtaataggtgaccaataccagcggtgcatgatgcggtggccagataacggcgatatcgttggtggtgccgtaatcgccgctgccggttttatccgcaactgtccagtcagcgggcaggccggcacgtaggctgttcgcccctgtggtgttgcctttcatccagtcgctcagttgctgacgttgcgccggtgccagcgcactgcccagcaccagcttttgcaggctttgcatcatggcagcaggcgatgtcgtatcgcgtttatcacccgggatggcggtattcagatccggttctgtgcgatcgagccgaaaagtggtatcgccaatgctgcgcgcaaaatgggtcaccttctgcggaccgcccagccgcgtcagcagtttgttcatcgccgcattgtcactgtattgcagcgcagccgcgctgagttcagccaccgtcattgtggcaccgacgtgtttttcagttatcggattgtaattaaccagatcggttttgtggatcgtgacgttttcattaagcaatccgctcgcggtttcactctttttcaggatggccgcaacggcgaaaactttgctggtgctgcagagcggaaaacgcgtgttgccacgataggtaaaaacggcgccatcggcggtgtccgtcactgccactcccagccttccgcctgcggtctgttccaactgttgaatatcgcgttgcaacgcggcgtcatcaaagctggcctgtgcggcaagcggggtcgcgagcgccagcaggataacggtagggcgtgcgcgttgtgtgaatagattaatcatataaaacctcatctgataaatgtccgcatcgctgagtgccgtctgcggccgggaagtgcatggcggtttaccgcatcattgcgcggcaggatgcaataagaaacagactggctgcccctcaataaacttatgtcgctttaaacggcgtgacgcgtcaggccattcagccctgcagtacgctattcctcgattttgttaaatcacgagagagatggtaggggatttcaaaatgtcgacaagcgagataatttgagtggagactaaagaatttctgggggtaaacgtgaaaaatgatgtaccgcttaacgcgcttcgggctttcgaagcctccgcccgccacctgaattttacccacgcggggctggagctgtttgtctctcaggccgccgtcagccagctggtcaggctgctggaagaacgactgggcgtcgtattattccgtcgattgccgcgtggtctggagatgacggatgagtcgcggctgctgtttgcggaagtgtcagcggccttcacgcagctcgaaagcgcctggcgtcgctttgaaggtggagaataccgcgaggtgatgacgatcgcctgtgtgggtacctttgcgctgggctggctgttaccccgacttgaggtgtttcgtcagcagcacccggcgctggagctgaatgtgcgcactaacaataacgtggtcagcctggcgggtgaaggcgtggactatgcgattcggtttggcgcgggtgcctggcccgccacacacaatgagcggctgtttacggcaccgctgacggtgctctgtcgcccggacatcgccagccttctgcagcagcctgcctgtttgttgcaggaaaacctgttacgttcctatcgggctgatgagtgggacagctggtttacggcggcggaaatgacaccacccaggatcaccggcccggtatttgactcgtcacgtttaatggttgaagccgcgatccagaccggcgctgttgctctggtgccggcgtgcatgtttcagcgtgagctggatgccggcacgctggcccgtccttttacgcttgagatcgatgtcggtggctactggttaacctggctccgctcaaaaaagatgacgccctcgatggaaatattccgtgaatggatagtgcagcaggcaaaaggcggtcatgaagagccggatcagcccgatgcaggcggcgcgccttaatgctaaacgccatctgagcagcagcatcgtgctcaggcggcaaggcggctctgtattcactcatcgtgcagagaaaaagcgttaacggctacccgctatgacggatgtaaaaaacagcctgttcgggatgattcatttcatcaggctatcgctgtgtggaagcctgcggtgttcagttttttcagtttcgtcacgccctctgttattaagaaaccagataataaactcactgttatttttcacgccaagctttttcattacgcgttgtttaatataatatgcagcgtgtacagggagtgccatccagcttgctatctgtttcatatccattcccgtcataaaaaaccacgttaatgaaatctcatcgaccgttaaacaaacctgttgtccgtcgttattttttatttccatgctgtgctccttttcaacatacagctgtctgatcagggctcatcatagcgctgggatgaagtaatggcatttcacgtattctttgcttatcttaagtctttaatcttcatttaaatcaattgattactcttgttttctgatctgcctgagaaaggtcaggttaagcgaagaacacatgacgcatcatgtcgccgctgcgcgccagtgcatcagatatcgtggggcttgttgagtccgtgtgatatacagactactctgcgattgctttttatcgcgttggatcgaatgcgcggctgagccttacggcaataaacacctgcgcttctggtgttaatcctgttggacagataacaccatttgaattttgcgcaataaacttctctttggctcgttatgtattatgcggctactgtatttgaataaacaggtaatgctaagggaaggggagctaaaacgtaacgattcccgaccgggtttacattatgttatcgccagggattcagggctatatatttcagaaaacaggcgtgacaggtaatttaaatccagccagtaacaaagaactgaaaaaaaccgggcgagtcgtcaacagaaccgccttatgtcttgttttgcgcagtacagaacgtcagccagagacgtgtaaacccgccgagtgcttctgcaggggatggcaaaaaagggagccatcaatgaaaaaatgccaggcgtgcagaaggcaacaggtgaaagcataacctgaatgcgcaatcgttaagcggctgcgtaaaaccgacaccgtttcgctgtaacaaaatcttcatccacatcaaccgcttcatataaacctctgccgtttcacttgatcaaacccatcgatcgcgattactgtaaatatatacagttattttgaaggggaggtgagtatggaatttatcaggccagcaaaagtcagtgcgctgttaccgctgccactgtttatggagcgggtgccatgtggttttccgtcaccggctcaggactatgttgagcaacgtcttgatttgaacaagctcatcgttcagcaccccagttcgacctactttgtacgggtaagcggagagtcgatgaccggcgcaggcatcaacgacggcgatatgctggtggtggacagcgcgctaagagcctcgcatggcgatatcgtggtggcgtccgtggacggagaatttaccgttaagcgtcttcagcttcagccctgcctgcaactgatgccgatgaaccggcagtttaaaccgattgcgattagcacggaagatgcgctggaagtgtttggcgtggtgacctatgtgatcaagtcggtttattaatcatgtttgcgctggtggatgtgaacaatttttatgcctcctgtgagacggtgtttcgccccgatctcaaaggaaagcccatcattgtgctgtctaacaacgacggctgtgtgattgcgcgtaatgcagaggcaaaagcgctgggcattaccatggctgtgccgttcttcaaaatgagagagattattgcccgccacaacgtacaggtctttagctccaactacgcgctttatgcggatatgagcaccagagtaatgacgttgctggaggaaatggccccgtcggtggaaatctactcgattgacgaggcttttctggatttaacgggcgtcagccattgcatgtcgctcgacacgttgggccacgagatcaaaacccggataaaaaaagaagttcatctcaacgtctgtgtcggcatagcccccaccaaaacgctggcgaagctggcgaattttgccgctaaaaaatgggcaaactacaccaagggtgttgtcgatctgtccgatcctgtgcgtcggcaaaaactgctggtgaaggtgcccgttgcggatgtctggggcgtaggtcgacggctcagccagcggcttgaggaaatgggcataacctcggccgcggacctggcgcgtcagcgccccagcctgattcgtaagaacttcagcgtggtgctggagcgcacggtcagagaattatgtggcgaaccctgtcaggatttagaggcgctcgaacccaccaaacaacagatcatgtgctcacgttccttcagcagccgcctctcagactatgcccaggtgcgtgaggcggtctgtacctatgccgaacgtgccgccgaaaaactgcgtaaagaaaaccagtactgcagacaaatcggggtatttctgcgcaccagtccgcatgcacccggcgaaaatttttacggtaatcaggcgacagggcaactcctgacgccgtcccacgatacgcgcgatattattcgggtggcgaccgagatgctcgactatatctggatagaaggacaccgctatatcaaggccggcatagtcctgagcgatttcttcgatcatggcgtgacgcagttggatatgttcgacgagcgttcggttaacccaggccgtaacgatctgatgcaggtgatcgatcggattcataaagagggcaaaggaaagatgtggtttgccgggcagggcacggaaaaacgctgggccatgaagcgcgagatgttgtcgccttgttataccacaaggtattcagacctccttatcgtaaaataaccttttacatcatcatattatgatttttcatgacgcaaggtgcacacggatgcccgctcagtcatttgttgaaatccagtttgtcctcaacataatcttgtatctgaaaaagtgcagttagcatgaaaccagtacgcagacgtcaatgctcgcggctcacccggcatctcgcacacctcaatccgaagattctctttgaactgagccaccggcttcatttttttttaggtgaaggttccgcgttttacctgaaagaaggactgttccggtaatgcctgttagcgcgataagcgaactcatcccagcaaaagcaaccatcagtcccccagctgcgagcagcccggaaagaaggccagaaagggcttcagcagtgtttgccagtgtagagaacgtgccgaatgtcttacctgtattctccgccggggacaacgtctgtataactgtcacaagcgcaatatctacaaaggcaccgctgatcccaagtataaatgcgagaggaagaagaaaattcaaggaatacagagcggtaagtgacattacaaataaaagcataccgtacaagaaccagtaccgcattactctctcgggtgaagcctgctttaaaaaccgaccatagataagtccaccagtgatcgtgcctgcggccatgagagaaaagatccaactggttatcagttccccctgtccgtgactgactgtcatcgcaggaattataaaacgcagaaccgatccggtgaacaggatgcagacggaagagcacagtatggtgatgaatagcccacgggtgtcataataaaggccctgtatacaggaccaggtttccttataaacatttttgatcctgaaagccgatatttttaccgctaccgtttcagaaaatgtgaagaggaaaataatcgatacagcataggtcaagtgttaaagagcaggacccatgatttatccgagaatgtgagtatgaaggaacaaataagagggcctgccaccgaagccgtttcttcggctacctgcgatataccattagcaccggcaagccttgatgcatcaacggttctgggcacagcggtctgatagcttggctggaagatactgcggccaatggttgtcagaacagaagccacgataaggacggtgatactgaccgaaccattcaggctgcatatgaaaagaagaagcgacacaataagacgcagccattcgctgagtaagaggttatgtttaaggcgataattatctgccatccagcctccaaccgggccgaagaacagaaagggaataaaccggaaaaagtaaacgaaaccggtaagcagataatcatgatgtgtgctctccagcacgataaatacgaaaaccacttcgtatgcataatcgcctgtctttgacataaaaagcgaggcgagaagggttcggaaattcttaatcttcagccagttcatgacagtccattcccatactgaaacgcgaagcgcccagcgcagaaacgccctccgccagttcggtaattctgacgttcctgagtgcgccatttgagctggtacgggcgataaaggatgaagcaaagttgagcgcgatccccataccgatacacatatgcatcccggttccgaaagaaagtggtttctcttttcgacccggaatgaactggaaaggctcatcaaaaaccccggcatcgaaattagccagcgcggtatagaacataaccctgtcaccctttcgtagattcagccctctgaagctcagatcctgagacatcactcttcctacggagagaacggggctgtaaaaacgcgaggcctcaaccactatgtcgcggacattatctgcatttactctcagactgaagtgagatatggcccagagcgtggccacaatgagctgcatggtcgtctgatgcgcagcaatataggcgatagctctgtctgacgcctgaacatcggtgcagggatcacagccagaagtcatgcctctgcaggcttcaaaaacggccataaaggaatgcgcaatgtcgacaaaatgttcctttccctttactctgccgtcgaaaagcatacccacattatacgcatgatccgacaagtggcgggcaggttctaacccgacaagcatggccgcaagcgtgttattgaggttgataagatcatgctcatcaaggtatttcttttccctgatctgcaaaagtgacctttcaatcatctcgtcgcagggcaattttttgaaattttgatgaataagccggaccacatcacttttacaatcgtcccgaaaaatcagtgactgattaataagtaacataaaacgttcaatgatcgccttttcttgctgaaatatgctgaggggaacaagcattctgttcttggtaacataatggctgttcagcagttctgaacagccagcataatcataaataacccagtgttaatcacctgtcagcaatttcatatataataaaaaattaataaaagttaactttgcatttacattgttgtgataatgatcgcgaaaaacttaatgaaaattatctattaatgcgttggttttgattggaaaaatatatctgaaatatttcgcctaaaaaaataataatatttatagttatttaatcacaggatgaaattacttaaacatatatcaccctgatgtcttgatgctggcattaaaatttttttagcatggctacagcttccttacccggcgtcgaaaactgcacccagtgatgcgccgtcacgtcaagtgcgaaaactttcgtatatccctctgtcaatttcaggattttgtggcccatcaggctctgtagcggcttcagcggaatccccgcataaagcatgtgcatgtagctgtgccggaaggtgtgcggcgtcacaggaacggagaacgtcacgccgccttccgttgcggccgctactgcacaaagggatgggatagcgtcagggtgaaatctgcacggttcagggcaaatgcttcattaatacgtgcccggtgttccacatcgtggtcagcagcttctctcaaactatgcccaggtgcgtgagccggtctgtacctgggccgaacgtgccgccgaaaaactgcataaagaaaaccagtactgcagacaaatcggaggacatctgcgcaccagcccgcatcagcgattttcccgtggtgaaatgatggaaccagccaggttgagatcgaggttgagggcagggcagacaacggaatgctctcataaagggttcgttttgtgctggcgcgctgcttaaacctgactttctggtctaggatgaaacaggtattcattcgcccttaaggagaacattgtcatgtcagaacttagtaaatctccggtggcagatcaggctgaacataatgcctttttcccatcagcctactctcttgaccagttcaccagccctaaatccgatctgagcgatgccgggtacgcgcaaccgcacacagggaataaaaaaattctggtcatctgtgccgacgaacgctatctgccgttggataacgacacgctgttttcaaccgggaatcacccgattgaaacgttgctgcctatgtaccacctgtatcaggccggctttcagtttgacgttgccacgctgtctggacaaatggtgaagtttgaacactgggcaatgccacaacaggatgaagtggttgtgggattttataaccactgcctgtcgctgttccgttcgcctttgacgttaagtgacgttgtaacctcactcacgccccattccgactatgccggtgtgtttattccgggcgggcacggtgcattgattggactgcccgaaagtgaagcggtggcagaggttatccgctggacgctggcaaacgatcgccatctgatttcgctgtgccatggcccggcggcgttcctggcgctggacaaaggtgaaaatccccttaacggctatgcaatctgcgcgttcccggactcagccgataagcaaacccccgatatgggttatatgccagggcacctgacctggtattttggcgagaagctccaggcgatgggattaacgctggttaacagtgatatcaaaggtactgtgcataaagatcgccgcgtactgaccggtgacagcccgtttgccgcgaatgtcttaggtaaactggccgcagaggaattgttaaacgctaaccgctaaaagctaaaaggttcgtacccctgtcccgcgcccggcgtggtccaggccaggcttctgcattcgggccgggattcggggtgtacttgtgatccacgactgagatacaatcacccgcgcatatcgttttcggccgagccgaagatgccgcctttcaaattggtcgtcatgaacagccaaatcgctacagcgtatcaacacaaagaacgaggtcggcccagagagttcaatatggaacaggctctggaccaggcgatgattgtgtttcggcaaaagggatatcatgccgcatcgctagccgatttgggtaaagcaatgaacctctctgtgggaagtatctataaagctttccaggataagcgctccttgtttctactggtctttcagcgctatatcgccgttcgcaatgaggatttgcgcggacgactggcccgattttctaccggccgcgcgaagttaaccgagctgttacagttttatctggattcctcccgggcgacagaagggcgaacaggttgtctggtggtaggcagcgccattgagttacaggtgctggacgcagagctgtcgcagctggttgcgcaggtcatcaaccgtaacaagcaatttttgatggcgttattgcaggaagggcagcacgatggctcgatctcagccagtctggatgttgagacggcagcaggcctgattttgcgcatcgcatttggtatgcgcgtcacgggcaaggtcgccgatgtaaccgatgagcaagcgactattgcgctggccctgaaaatactggattaacatttgtctatttaggaagcgaatgtttcctaaattttgacacaacgctgaccgtgactgcacaacatgcggcgcgttgactgggcggccgaacacacgccgtcgcgataaattgatgatattaaatgaaaagtaaggttcgaggaaaaggcgtgaaacaagacaggacagagattggtgaagagatacacgcgctgttaggcaggattgtgtcaggtattctccagcccggagaagcggtgacagtacaggaaattattagcgccctgcatcagcaaagtgttctaacggagtgcgaaaaaaccaggctgacctgtgaacaggctatccgcatcctggcgcataaacttcactagcggatagcaatgacgggcaggacgtttcctgcatagcagtaacagcagtaacagcagtaacagcagtaacagcagtaacagcagtaacagcagtaacagcagtaacagcagtaacagcagtaacagcagtaacagcagctatgccgcgactgctctgacaaagaccaacccgcctgaataacggcagcccgttgccgcatcaccgcccaaagagcaatccaatcagttcacgacacagacgctcttcttcctcacttgccgacagctcaaggcggcgcagcagcttagtgcagatagctttacgattcacgttctggcctgcacgtaaaatatcaaccacgatctgccccagcatttcttgctgtgaaggcaggctggccgcagcaaaataacgggagatatcgtcggcgctctgaggtaggcgatggttgtgttgcataggtgctctcgcagtggtccaaaaatagtcagttgaaagttgcgtaaagttatacaataaaataaaacttgtacagatatttcggtgggaaattgtgcgggaggtaacaggatgcaagtgaagtacgtcaaagcaggtgatcggcaacaaaacgcgccaggagcggatgatgattgcgcggacgcagagcgcgcccgcgcagagggataaccgactgacctgctgagttaatgctcggtcaaattggcgggcacctggccggtaacaaccatccagctgagttctgcccgttcccgtgtcgcgacgttaataaagcttttcagccatttacgggcatctgcaatctgaataacccgctcgtcgtcgatttcattgtccgccatgatgcttagctgacggatcaacgaaaccacagttatctcctcatcctgtagtgccaggttcaccgcagcttcaccaataatcttatgaccggtagcttcatcgtgaaaatacatatgcaactcctgagtgagtgagaatgtcgtcgacccagtaattagtttagtaaaagaaatgcataacgaaagtgttatttcattaggcgttacctatcaaataaacctgcataaaaagtgaactttgcgataagcaggctaacctcctcaaaaggaagggaaaaacgcatataaagcggttttacggtaaaagattgaagtgattaaaccactagatatgtatttattggcctgaaattaagataggtacttgacgaaaatggactgatatcgcgccattattatgactttttcagcggaataacagcgataccgcggcgagaaaagggccaataacatcaagaaatatcacgcgggtgattaaaaaagcgctctgtctgatacgggagccagggcaacgggcttcacacagcggcagggcggcctgtgcaacagcttacctttatctgtgccacacaaaatcctgcaaacaataaatggatttgcgattgtcgcctgtggattaacggttaaaacagaaggtctttaagaaaggggcagggcagatgggaaataaaaatgccgccctgggtgggcggcaatgatattagtgggggacttcagagacagctttcacgtctgttttattgatctgctgtttcacaccgttagcatcggtgtaacccagtaaaccggcatccgattcagagggtttgccatcgctaataatcgtacggccatcgttagtatgaatagcataactggtacgtgtgcaaccggttaatgcggccatgccgatcaaaactgccagcggtaaaatcagagtcttcttcatattattcaccttatatccatgatggaattaattagttattaagttcactcatattgctgatctgatcgcgattgatttgttcggttttgcctgtctgtgcgtcgcgataggaaaccagtccggtatcgctgtcaatttgaggcttaccatcggtcactatggtgcggccgtctgaagtcttaatggattgatttgaagagcaacccactaatgttgccagtgaaagggcaagcaaaacggcagctgagaaggatttagtatgcatttcatctccttgaagtggaccttgaattaaacagcatagtcgcttttgagatttttgcaggcgtaaaagcgaaacagcgcaaattaccggatggaaagcgcgaatcgctaaatcagttcaataacgaaccatgtttctcagaaaattcacatttatcccctgtcgttaggtattttacctgacgccctataacctcgtttgcaggttaactcaaaaaaggaatcgataatgaaatggcaaacgggtgcagttgcagcgttattaatgggctcagtcagtgcgtatgcagcagaatcaaccagtatgaaaaatccgctgagtgttcatgtattaaacctggaatctggcacgccaaccccgggtatttccgttgacctcgaacataaagagcagggcaaatgggtaaaactcgcctcgggtgtcaccgataaaaacggcagaattagcgcactgtttccagatgataagaaagttgaaacaggagattacaaagtcgtctttaaaacaggcgattattatcagaaagtgcagcacaagtcattttttccggaaattccggtgatattccatatggacagtagcgagccgcattaccatattccgttactgctgagtccttacggctattccacctatcgcggtaattaacagcgcccggcagcgccctgataacctccgctgccggcacgttttacctcatctcgcgtcagcaacacgcgctggctgaccgcttaaccgcagccctgcttgtatggtcataaagcctgtttagacggactcattgaataacgatcagaagcgatatgtcaccagcaggcttccggtgggcgatgtttttcgttgcacaatcgggctattgcgcgcatcccccgtcaactgcgtaacgcctgctgcggcaaccacgctccagtcctcattgaacttatgtgtccagtcaagattcatcgaccaggcgtaaactcccgctccggcatcatatcgggtaaaccttgatgcggctgattgggatgcactgactccgtagtaagtctgcatgtatttgtccgtcccccaactgccggtcagcgccagcgttacggtattattcggtgaggtataaagcgggctattaatgccaaaatgcagtgccgcgccattgtttcgttcagaaaatggcacttcagcctgcaattgcaaattaagccagtcggccacccggtatcccaggccaaacacaccgagagccgagcctttgacgtcgcccataccacgcaaatagtcgctgccgtcgctcagcgagtcgctgtccacgtcgtgatccttccgacctgcgcgatagctcagcgcagcgttgtaatcgaatttgccgatgttattgccgtaaccgatgccccgcgtggagctggcgaagaaaccatttgccattgtgtaatccagcaccatggcggtcgtgacgcggcttttatccgaaccagaatagcgtggcgtcacgttcgcgccgcctcccagagtcaacgcgttgtcctgattctgtgctgccgccagtatcggggttgccagtaacgccaggacggtgcccggcaacatttttttcaggctgcgccccgggagtgaaaaggggaacttatgacgcagtatgttatttctcattaaagaagtcctcgtggattcaaatgattacgatacaagcgggttgtaaacgccagaacgcgcattttgcaggcgcccgctaaagttctcatgagcccaaaatgaagaaagggtgaagcaaccacagaggcggcaaagctgatagatttcctgataccgtttttttcttcagacgttcttcattcactgttgataccgtaaccattgtgaaaatactcctaatcgaagacgacctggatctcggcaacggcgtacgtattgcccttgcagatcaaggatttgatgttatatgggttcgccgcaaagaggatgcgctgcatcagcttgatgtctgcgtgcctgaacttgtgttgctcgacctcggattacccgacggcgatggcatgagcctgatggcgtacttgcgtcagcagctcaagggtattcccgtcatcatcctgacggcgcgaggcacactgcacgatcgcctttgcgggctggacgcgggtgcagacgactatctcgtcaaaccgtttgttctcgccgagttgttggcgagggtgagagcgcttgcgcgccgcagttatggttttcagaacgaggcgatagaactgcgcggattatcgctttatgtgcccacacgacgcgtgaccgtgaatgcacagcatattgagttgacggcaagtgaatacgcgctgcttgaaacgttgatgttgcgcactgaccgcgtgcttactcgaagttttctggaagaaaggatcttcggcgcaaaagaaaatatgagtaatgcgctcgatgtgcatatggggaatttgcgtcgcaaaatcggcgacggctatgtgcgaacggtgaggggcgttgggtatgtcattgataccgtacccattcagaagggggcaggttgatgcgaaatgtctggcgccttctgagaaccccaacgttcgtacggcgaattatggtagcgcaaatgctattgctcaccctgctctggtgtctttttctgacttacgttttgtgggaggacttgcgtagcccgccaatattaacgggcagcaagacgtacgaaaccatttttactgtggttaagaatatggacgatcgcccgcaggcgcgaacgcatgtgctggctgcattaagtaaggcagtgcgggaaaattatggcggcggtgaagatccaaaactctcaatcagccttatcgtacgcaagaataaagagatagtttatgcctctgatggtgcgccagcgggcgtgataaacagccgttatggaaaaattgagcgtgttgagagtgatggtcgcgcctggaccagccgtaccttaaagtccgggaacgccgacacagaggtcacgcttatcacccctgctggaggctggaatttctttatctacctgaactcgcgcggctactacgtgatgccgctgctggtatgcattccgtttcttttgtttcctgcgtggctgtcaatccgcattgccatgcgcccatggaataaggtggtaaatgaagtgtccttacgcacgccggacgatctctcgcccttaaaagcagtgccaaagcacagggagcttcgcctgatggttgacgctgttaatggatttcttgccagagtgcgggaaagcactgaacgggaacgcgttttcattgccgatgccgctcacgagctgcgtacccccctggcggcgatgcgaatcaatgttgaggcgttgcagtcttatgtgagcagtgacagccaaaaagagttgcttgcaggcattattcgcagtaacagccgtgcggctcgtctggtcaatcagttgctgctgatgatgcacagcgaagcgcgcattgacacggttatggagcctttgcagatgacaacgctcatacaagaacgcatggccgggctggcaccgctcgcggcggaacgcaggattgaacttgaattctacgccgaagaggaaatctgggtgactggcgtcagggagcggttgatgtcgcttatcgataacgtagttgaaaatgcagtgaagtacagccccgggggcgggagggttgaggtggagttacgatccttagaccaatccacgcagttacgtgtttcagatgcagggcctggcattcccgttgaattgagggagcgcgtattcgacagattttttcgtgatcccaatcagatgcaaagcggaagtgggctggggcttgccatcgtcaaagccgttgcacagcaacacaacagcagcgtacgcctcagtacgtcggaagaaggtgggctgatggtttcggttaatttcccaaatcacaaatccgcctgaaagcaaacaccatcttgatccgcgccggcgcaaggcatttacctgaatgatggagttaaaagtgaaatacgttgctctgacaagtctgttattttcgctctcactcagcgggtgtgctattacagtcagcgaactaaaaagcagccaatcctcttttgacggcagtttcgtgagcaacgcagggtcttctgatacttatcgaaccataaggctcatggcaaggcagtgcctcgaatatgaggcatattcaggaaatccggtaatcgtattaagcgagtttgatggtgagcgcagaaaaggggagattaatcagaagtttctttcacagggactgttgattaacaacacgctaattgagatcgaaagcccggagggtgaccacgcgcaggtcagcctgtatacaaccaagaacctcctgagcacgggtatccggtcgccaaagataagtgatatcaagcgctgggctgacggcgataaaacgtgctagcgcgacgctgtgaagcatccctgtgatatgacttgcgccatattgattaacacaccgcaacgttaactaataccttcatcagaggtgagagccactgcgaacgtccgcttttcgctctcagcggacatcgttcttcgggccggtccgctcagtgccagaggaaggcattgtaggttcagaaacaagcaaataaatactattgcttaaggcataatactacgtggctaaagagatagtatggaaatctggattgatgagtaacaatgagttttatttcggtcatgaactgactgttttccttgactgccattttcattcagactcatcccgactggtgcttcatttacataacgtaaagtacctgtcagcgcattttagaaaatgcaacaatgtaatcacctcaattacgaaaaatgcacttctgcaatttaaaagaaaaatattgtttactatcacatcttctttattgactgcgaggaaatggctccctgataaaaggaatttcaagacaggcaatacattgccaagggaagaaaaaactaataatttcttaaggattcaattttctgctcccataaataaaaaaacgattaactacttgtaattaaagggtaattattctcaatgataattaaagattagatggtgaatgattggtgaagtaatgattagcgcgcatgttactaaaataaaaaacactaagtgtgactgaaatcaaataatcacaacatttaagctggatttagaaaaataaacatggaaattaaattactcatgccgatattagatgataactctgaggaaattaagtgctcggagtattagccaacacagggattcctttatgaaaaatataaaaaaagtacctaatttgaaaataggcggaaaattatttctgggctttctgctggttatactggctgcggcagtcatctcaacactggcatttcgctgttttttacaaattcgcgaaaactctgccaagcgtgatattactgtagagatgcttgactcgcttgcgaaagcaaggctaaaccgtacactttttcaatacaccggtgatgaaaaattcatcacactaaacaaagaggccatgacccagctatcgtctctgaaaaataagcttgatgagttcacctggtctacagcaggaagtgagaagctatccagtcttgagttttttttcaataaatacaatcacatacgcgagggttttctttcaaacgccagtcagtcagccctgtcattagatgagttaaaagcactgagctttgcccaaatggcggacaaacttagtctacggcaggcatcagtacctgcagagtctgttacggcattaatttctctcagccttaaactaagtcaggcggcattatctgttgaagaattgattgaagcaccggtcgcttcctcgctggataaattcagcgaaatcaagaacgaactccctcggttgattaacagccttaagggcgtttctgatactgaagtcaccgaattattggtggctgttgagaaaaaagcctcattgagcatcccccttctaaacaactatcttcttgcagtgaaggcggaaaaactggcttcagatgaaatgacagcagtcgcgggaaaactcgacacggcgatgaaagatttggctttctttcagacgcagatggctgctacgttcatcaacacggcactctggcagattggtttcaccacgctcacttgtattattctcagcctgctggtcgcctggagaatgacccgcagcatcaccgtaccactcagagagacgctttcctcagcacaacgtatagctgagggtgacctgacctcagaaatcaccagcacccgaggcgatgagctgggacaactgatgactgcggtaggtaccatgaaccatagccttcgcaacatcattgtccgggtaagggacggagtgaacggagtggcccgtgcatcttctgagattgccgcaggtaatactgacctctcatctcgcacagaacagcagtctgcagccgttgtggagacagctgccagcatggaggagctgacatcaaccgtaaaacagaacgcagaaaacgcacatcatgccagccagctggcaactgaagcctctttaaacgccagccgcggaggagaaatcatcagcgatgttatttccactatgggaaaaattaaccatagctcgggaaggattggtgaaattattaccgtcattaatggcatcgcatttcagactaatatcctggcacttaatgccgcagttgaggcagcgcgcgctggtgagcaggggcggggcttcgccgttgtggcaggagaggtaagaaatctggctcagcgaagctcgcttgcagcaaaagaaatagaaacgctaatccgcgagtcccttgacagagttaatgacggcactgagctggttaatcgtgccggcggtacgatggaagacatcgtccggtccgtatcgcaggtcagggacattatgagcgaaattgccgctgcttctgatgaacaagaccggggaattagccagattgcacaggcgatgaccgagatggacaccacaacacagcagaatgctgcactggttgaggagtcttctgcagcggcgagcagtctggaagagcaggcacttgaacttgaaaaaacggtttccatattccgtttgccgtcttccgggtcactgataccaaccagaatgccggtaattacaggccgttcgctggctccggcgtcagccagaccatcatcttccaactgggaaacattttagcatttagcatatatgcggctttataaacctgtcaggtgctttgaaaactgcacctggcataccgctcaactcgttaaggcctgccagaagttatctgtgagtgattacaaaaacttccaggcagtctacatttttactggcgaaacgccgtaagttttttgatgattatgattctgctattcgcacaaaaattaaatgataaactcaataagcttttctgctataaaatttgggataatggaaaacagaatttgtaaattcggtaattattttgagtaaaatattctttaaaagaggcaagagtggcttctggacagtcaccacttttcgttcctgacgggcaataatcaaatacttcacacctccgggagtttgattatggtcgcacaactctgaaacgctgagtcgtcagaggatgatttctttccatgttcacccatgacttatctgcaccttctttagtgaatccacctcgctgcggaaagcgcagaaagcacggcactatttaggatgagcgataaaaccctgtgccatgcggcgttacgactatcgcacggtttaccggaattagatggaccagcatcgtgcccatcatcgctgaatctgctctgcatcagcccagttactcatatggctcggtatttggttacaggcggaactcctttatgacgctatgcaaatacgatgctggattaagattgtgtagactgccgaagggccagcctgacaagaggcgctgaccctgatttagcttataagcactgcccacacttgtgaggccggacttttttttagcgtagaatcaacttctgtattctgttgctatacaattcgaggcatctaaacagcacgacctcgcccgatatcagcttggtgatagtacagctcaaaaggtcatctttgtaacgtaagtaattctttctctaagcggtcaagacatcccgagtttatgtctgcaggagatgttgcacctgtcagtgtcatcgtcactttcatatcttcagcatacagccgtagtaaatgttctactccttcttctccggctgcggcaagagcataaatgtacgcacgccccagtaaaactcctttcgccccaagagcaagcatgcggataacgtcaacgccagaccgaataccagagtccactaatacggtgagatcgtctccaacggcatctgccacacgaggcagagctcttgctgttggaactgcgccatccaactgccttccgccgtgattagaaacgacaataccatcagcgccaagccttactgcattacgtgcatcctcaggctcaagaattcccttaatgattaggttcccttgccagctttcgcgaatccactccagatctttccaggtgatagatggatcaaaattgctgctgatgaatcccatatagtcggccatcttcatcttatgcctggtataagcctcaatattaccaaaagacaggggacggcctctcagcccgacatccagagcccatcgagggtgaatgcacgcctgtacatattgcctaagcgtcgacatcggtccagacattccggaacgtttgtcacggtatctggagccaggtatgggcatatctacagtaaacacgagagtcttcatacctgcggcccacgaacgctcaagcgcattgcgcatgtatccgcgatccttaagcacataaagctgcgaccagagttctccagatgcatggctcgcaacttcttcaatagaacaaactgatacggtagaaagcgtatagggaatacctgttttagatgcagcccgagctgccttgacttccccacgacgggcatacatgccagtagctccaacaggacctaatgctatgggtaaggaccatgatgacccaagtattttggtggacagattagtttcaccgactccacaaagaacccgctggcgaagagctacggatgacagttcataagcattggcattcattgtattttctgccacagccccaccatcaatgtaatcaaagagaaatcgtgggatgcgcatacgtgcagcttcacgataatcagcgggcgatgaaactatcattttatcttttccttatttaatagaatcaggtaaatggtctgaatacagaaaaactatatgcttcgtaaaacctttacagaaatgaatttttagaaccgaaatcatgccttttaggaatgccttgagtttgaatctgattatttttccggcgatacataagaagacgtattcaatgaatttatcagtgcttacgggggggagcttctcgtccgagagtgcaacacccaacatcaagggtgggatttgattacgttccgggcactactacagcatcagggaggacatatggtgttcgaaagtggccctgagtgaaatgcacactccattgtgatgatctgacatattcctcgaaacttaacatactccggcttaagtattcccacattaatgttcagaatatctactgactcctgctgtatacatattgaaaatcttatctgcaggaggtctattccgagtgtttttagacgaatgaccagcctcctgaaagttaccatatgttcatattagttcggcatcacagaagtaatgacaaacgcgaatttcctcttttcgctcatagcagacatcggtctgttgatgagttcgctccgtgccagaagcggaaattaacctcaaatcaaccagcaaaagtgctattaacccctctccatgaagcttttttttaagcttgagttattaattcaaagcagttgttgaggccagttgtgcaagatttttaatgtttactcaaaatttggctggcttatatcaaattcccggcgggcgcaatggaacgtgatgagtttgacttaattgcagtgggacgagctctcattagcaactctgactgggttaaaaaaatacgtgagggaaatgtcggcatgttaaaaggttttgatgcagcaatgctcagagaattggtttaaacattctcaggctatttatacttaccgtatctatgccaaaattttctaaattgataacataaatacttatgtctaagttcttcagataaatagctgaagaagcggaaccactaaatagtgcaactatattgatagtgtgtgataacgaagcgcatgaaattctgaaataggcgctgactgtcacacacttttttaaaatctgtcactcatgtcaggctgacttagtttcagacgattatcgcatgttactgctggttctgtagttggcaaatgtccgtttctcgctcatagcggaccttcagctcagtcagcatgtccgctctgtgccagaagcggacatggaaaatgatttttagccaatccaggatcaaaagttaaacctcgcattagccggatgttgtcaataaaacggcgatgtttgttcagcaaatttcagcagtgcctcgccatcaagacgatagcgtacccattcagattgcggcaacgcgccaatactaaggtaaaaatcaatggctggctggttccagtcaagtacactccatttcagtcggccacactgtcgtttgacagctgattgcgcaatatttttcaacagtgcctttcccgcgccttttccccgataatcaggagtaatgtataaatcctccatataaataccgttacgtccaagccaggtggaataacgggtgaagaaaacggcataccctatagttttacctttactttcacagattaacgcttcggttttactgcctgcactaaacagtgtttcccggatctcatctggtgtggtgaccacttcttctggcgccttttcatacatagccagttcatagatcatatcgtaaattgctgttgcatcttccgggcgggctgggcgaatcgtgatactcattagttttcctgtgacctttggatagtatcgatattgatggtgccaagcataagcattattgtttaaggaattaagtgcaatgaaatcactaaatggtgaatattatgcattcagcgctaagacgtcttgatctaaaccttctgccaatttttgacgcgatttatcgccaccgttcagttcgcctggctgcggatgaattggcaatgagcacatcggcaatgagtcatgcgctttcacggctacgcatcacgcttaatgacccattattttttcgagaaggtcaccgtatgtgtcccagcgtgtatgccgtccagcttgcgccttctatcgcgtcaacgctgaacgacctcaatcagcaactgactccgcagccaaaatttgaagtctcaacgagcacagcgcgttttcagatcgcgataacagattttaccgcgctctgtgttttccctgccctgatgcataaattgcagcaggaagcgcccagtctgcactttgagttagtctatttgccacatagtccggcgctgacagagctgctggcgggcgaagtaggcctggcgcttgggttcagcacaccagatgagattcgacatcccgaactggaagaacttacctggttcgaagatgaatatgtcgtcattagtaacaaaaaccgaacgcagcttacgctggaagattatctcgctgcccggcacttgattgtgacgccctggaatgaaaagcgaagtgttctggatctacagcttgagtcgatgggttatatacggcaaatagcgattaaaacgccatccatgctcagcgcgccctttattgttgcggaaagcgacctgctgatggctattccccgtctcgccgcagagaaactgctcccggtgacctgctccccgttcgagataccctcctttgaagtgaagatttattcgcataaaaggagcggtaaaagagatgcaactaactggcttaagtcggtatttaaacagctggcgaaagaggttaacttagtacaatgaatgcgaaaaatcgtaattataagtcttcttaattattattacgttgaagtagttgcagattacaaagactgaaagtccgcttttcgcttacagcggacattcatcacctgtaatcacttcacgtctttaaacactctccttggctgacattaaacacaactgctcacccggcagggcggcggtgctttcaccccccgttcttcctcattctgccgacttgtttaaaaacttttgctgatgcccaggctatcatcggttaaattgccctgagaggccggagcgcgcgtaaggcgctatccggtgcaaggtcaaaaacacctaacaaagcagaaggccccattacctgctttccctacaggagaattgctgatgttaaaaggattaaccgttgccgccgtggtcatgctgtcgggctgcagcctgatgcacaaggctccaccagcaccagaaacgttgcattaccgctgtggcaccttgccccttaccgtcaccctggataatgccaaacagcaggtcagctttattatggatggcaagccgctgacgctgacgcaaacggtttctgcgtccggcgcacggtatagcgacggtaactacgttttctggtctaaagggaacggcgcgttcattgagcgtaatgataagatcgttgtaaacgattgcgaattgcaaccggccagttaacgtttaccggagtgagtgtgcatcatgagtgacagtgacatgctacaaactattgcccatctgcgccgtgaatacacacggggtgggctacgtcgcaaagatttacccgataatccgctggcgctgttcgaaagctggctaaagcaggcctgcgaggcgcaactgcctgatcccaccgccatgacagtggccacggtggacgagcatggacagccttatcaacgcattgtgctgttaaaacatttcgatgagcagggcatggtgttttacaccaatctgggcagtcgcaaagcacagcagcttggtcataatccgcgtatttcgcttcattttccctggcacttcctggagcgacaggtgatggttttaggcgaggttgagaagctgtcgccgctggaggtattaaagtatttcagcagccgtccgcgtgacagtcagatcggtgcctgggtttccaaacagtcaagacggatttctgcccgtggcgtgctggaaggcaagtttctggagctgaagcaaaaattccagcagggtgatgtaccgctacccagtttctggggcggttatcgggtgaaatttagcactatggaattctggcaggggggcgaacatcgtcttcacgatcgtttcctttatcagcgggatcacgacggctggaaaattgaccgactcgccccttaaaactgcgctttccccctcatcagcgctggcacagaaggcgtcagcgctttatgctatagcccttaattttttccttccgcaactcagcggaaagctgtgtaccagcataggtgcagcctgatcaatttggagtcagtgatgaccagcagtaacctgatacaacaattgcaagagaggggcctgatcgcccaggtgacggatgaagacgcgttagtcgagaaactggcgcaagggccaatttcgctctattgcggctttgaccccactgctgacagcttgcatttgggccatctggtaccgctactctgccttaaacgttttcaggatgccgggcacaaaccggttgcgctggtaggcggcgcaacggggttgattggcgatcccagttttaaagccgcagagcgtaaactcaataccagcgaaaccgtgggtgagtgggtagaaaaaattcgcagccaggtcgcacctttcctggactttgactgcggggccaacagtgcgattgccgccaacaactatgactggtttggcaatatgaacgtgctgacctttctgcgcgacatcggtaaacacttctctgttaaccagatgatcaacaaggaagcggttaaacagcgcctgaaccgtgacgatcagggcatctcgtttaccgaattctcctacaacctgttgcagggttacgacttcgcctgtctgaacgagctgcacggcgtcgccttgcagatcggtggttctgaccagtggggtaacatcacctccggtatcgatctgacgcgtcgtctgcaccagaatcaggtgtttggtctgaccgtcccgctgatcaccaaatcggacggcaccaagttcggtaaaaccgaaggcggcgcggtctggctggatgcgaagaaaaccagtccatataagttctaccagttctggatcaacaccgccgatgcggatgtttaccgcttcctgaaattcttcactttcctgagcatcaacgagattaatgccctggaagaagaagataaaaacagcggaaccgcgccgcgcgcacagtatgtgctggctgagcaggtcacgcgcctggtgcatggagaagacggcctggcggcggcaaaacgtattaccgagagcctgttctctggcgcgttaagcgatatgacagaggccgacttcgaacagctggcccaggacggtatgccgaccatcacgctgagtgccgaggacgatctgcaacaggcgctggtcaaagctgagctggtgccttcacgcggtcaggcgcgcactatgatcgggtcgaatgccgtgtcgctgaatggcgaaaagcagtctgatgccgaataccgttttagcgacagcgataagctgtttaaccgctttacgctgctgcgtcgcggtaaaaaacattattgcctgattaactggcagtaacctttcagggccggtttccggcccttttttatggcaaggcactacagggcaaaaaagtgaaaaacgttttagcaattcagtcgcacgtggtgtttggtcacgcgggtaacgcggcggcagagttcccgatgcgccgtatgggtgtgaacgtctggccgctgaataccgtgcagttttctaaccatacgcaatatggacactggaccggtactgttatgccggccacgcatttaaccgacattgttaaaggcatcgccgatattgaccgcctgaaaacctgtgatgcggtattaagcggttatctgggatcggccgaacaaggcgaaaagattctggaaattgtgcgtcaggtgaaagtcgcgaatccggaagcctggtatttttgcgacccggtgatggggcacccggagaaaggctgtatcgtcgcgcccggcgtagccgagttccactgcaagatggcgttacccgccagcgatatcatcgcgccgaacctgctggagctggaaatgctcagcgaacgcaccgtaaccagcgtggaatcggccgtagacgcggcacgtatgctgataagtcaggggccgaaagtggtgctgattaagcatctggcgcgcgcaggacgccgcagtgaccgttttgagatgctgctggttaccgccgatgaagcctggcacatcagccgtccgctggtggattttggcgttcgtcagccggtgggcgtgggcgatttaaccagcggcttattgctggtcgatctgctgcacgggctatcgctacaggctgcactggaacacgtgacggcggcggtctatgaagtgatgctgaaaacgcatgaaatgggtgagtatgaactgcagctggttgccgcgcaggacgccatcgcccgaccgacgcacgctttcccggctgagaagctgtgaagctgtaaagaaaagggccggtaaggcccttttcatattagttaagtccttccgctttaagcgcggcctgtaccgacggccgctctgcaacgcgttcaaaccagcgttgcaggtgatccagcgctgccaggtccagactcagggctttcgcccagcgggtcaccacgtataaataggcatccgcgacgctgaaatgcacgcccatcagccactgtttgtcttcgagttcaccgttcacccaggcaaatttcgcttccagctggcgacgtaccagggctttgtactcctctggcgcatcgttgcggaacagcggagagaagctcttgtgtaactcgctgccaatatagccgagccactcaatcgtatggtaacgggtcaggcttcccaccggcgccagcaggtgacggtcgggcttgagatcggccagatactgcacaatggccccgccttcggtcaacacattgccatcactcagttgcagtgccggcacctggcctttgggattaatctggcgaaaatcttcaccgcgttcggtgagcttagtttgcagatcgacattaacctgggtgaagtccagaccacattcacgcataacgatatgcggtgaaagggaacaggcaccagctttacaaaacagtttcataacgaggtcaccatattgcgaatcgtgtttgcatagtaatcgcctgacgcggaattgccagtaataagaatgcggcattcaccggaaattgaccggcgacaaaaacaaaaaaaccgggccaggcccggttttgatcaaaaggcataaggtcaatcagactttgtcggctgccgtatcctgggtcatacgattcagcagcggcgcggttatcatcatcagcacggcaatgaccgcggtagcaataccaatctcctggaacactttgccgtaggtggccagagagatcagcgggtcggtaacgttttcagggaccgccatcagattagcgactttaccggcaatcactgctgcgccagccgtcgtcaggaaccatgagcccataataaagcccatcaggcgctgaggaaccagctgcgccaccatcgccaggcccagaccggaaatcatcagttcaccgatgctctgcagaccatagctgagaattaaccagttaacggacacgatacccgcgtcgctggcaaacttcgcgccaaccggtaacaccaggaaggccgccgaacacagcaccataccgatggcgaacttatgtggcatgggcagtttatcgcccagcttgttatagactgcggccagaattgggctggcaagcataatccagaacgggttcagcgcctggaattgctcaggggcaaaggtgataccaaaaatggtgtgctcaacgttgcgaatggcaaagaagttaagcgacgttggcatctgcatatagaggacgaagaacacgatggcttctaccatcagcaggaaggccacaatcatacgacggcgcgctgcaccacgcagggcaaaggcttctttggcaaagatgacaaagatgcccagcgcgatcaggcccaacagcacacgggcgatcgactgatgatgcagcatccagtttgccagggcgatcaggaccacaatccccaccagggtcatcagcagtttgccgaactgaagtggcgcaaagtctggtttggagccgaagtctttcaccaggcgtttacagaacaggaagttaagcagtgtaatgaccaggccaaccaccgacagcgaaaacgccacgttgtagccgtatttctctgctaaccatggggtcagcatcattgaaaacagcgagccgatgttgatggacatataaaacatggtgaatgcaccatcaatgcgcgggtcgtctttgtcataacacgtagagagcagcgaagaggggttagctttaaataagccacttccgacggcgatggttgccataccaatatacaccacgctgacgttgtggcccgagaaggccaccagcgcgtaacctattgccagcaccagcacgcccatcacgataacgcgtttggtgcccagaactttatcgcccagccagccgccgatggcgaccagaccataaaccagggcgctaaaggaggagaacagggtgatagagtcggactctgacatccccagttgcctgaccaggtaaaccgccatgatggcctgcaggccgtaataaccaaaacgttcccataattcgatcgtaaagatcagataaaacgctttaggctgtttaaatgcattaaggctgaccgcctcgtcggtgtgtttgtttgcagttgacacttgtacctctgttatttcatatcctgtgtcgcgacaggaattaagtccgcgccatgtgatcggaccatgggccagatttttattagatgggaaaaacggcgactaatttggctgaataaaggcgacagggcaagccttttctaccttctgcgggaaaccggttatctggcgttaaaacctaaataaatattattaattagcattttgttatggtttaagtcgattttacaaaataacatcgccacctggtggttatcagaacgttaataatgatattaactgctaaaagagcgttgcgccgagctttacatcgaaatgtgatatttcatcaggataatctggctaaaatgcaggttctgaagccgatttgatgaaatagtctgcggattatggcggaaatgacccgcaaaggcgtgaaaatgttgattaaggtcacatttatcgatgttaattcatagagagaaaaaaggtttccagcggaaataatgcctgtgaagcttcagtaattctgtctgaacagggcgcgaaagtatccgaatgctcgacagaaaattaaccttaacgtagcatcattatttccttaacaaggatttcgctatgccgttacctttacgtctcgcgctggtgggcgactaccgcccagaagccgttgcacatcaggccattcctctggcgcttgcccgtgccgctgactttctcgctatcgatagtgacccgcagtgggttgctacgcctgagctgggcgacttatccgccatcaggcaaagcgatgccgtctggctggtaccgggcagcccctataaaaatgatgaaggcgtatacagcatgctgcgcgacgtgcgggaaagcggcaaaccttttctgggctcctgtggcggtttccagtatgccgttatcgactatgcgcgcaacgcacttggctggcacgatgcaaatcatgccgaaacccatgatgaagggcggatggtcattgcgccgttaagttgctcgctggtggagcagcgcggtgaggtcacttttgcacccgatacgcgcattgccagggccgacgggggattatccagtgacgaaggatatcactgtaactttggcgttaacccggcattcatcacggcgctggaaggcagcaacctgcggattacggcctgggatctggacggtgatgtgcgtggcatagaactgaccgatcaccctttttatgtcgccacgctgttccagtctgagcgcgccgcattacagaacaaggattctccgttggtgattgcctggatgcaggcggcgctgaagcagcgttagatcaaaaagcaaaaagcctgtgtctccacaggcttctctcagtcgggggctgtttatcaggcaggatatcggcctattcgactttatcaggatactcgcacaggtcttcaatcaggcaggacccacagcgcggcttgcgggcgacgcaggtataacgaccgtgcagaatcaaccaatgatgacagtcaactttgaacgccttcggcaccaccttcaacagcttttcttcaacctgttcgacgtttttgccgggggcaaaattcgttcggttgcagacgcggaaaatatgcgtatccacagcgatggtgggccagccaaaggcagtattaagcaccacgtttgccgttttacggcccacgccgggcagcgcctccagcgcggcacggtcttctggtacgttaccgccgtgttgttccagcagaatgcggcaggtcttaatcacattctctgctttgctgttaaacaggccgatagttttgatgtattccttaacgccatccacgcccagcgccagcatcgcggcgggcgtattggcgaccgggtagagctttgcggtggctttattgacgctgacgtcagtcgcctgggccgagagcagtaccgcaatcagcaattcaaacggcgagctaaactgcaactcggtcgtcggatggggattagcctgctgcagacggctgagaatctctgtacgttttgtctggttcacacggcgtttccggtcgtgccttgcggtgcggcaagggcctgctcttcagcacggcgcagcgcccgctgcttcattttctgatcgatcaggtatttacccgccagcatcatgcccagaccaataaatgcgccgggcggtaacatggccaacagcatcggcgaattaaagtggatcacttcgatgcgcaacactttggcccacgggcctaaaagctggtccgcgccgttaaacaatgttccgctgccaataatttcccgaagggaacctaataccaccatcgcgcaggtcgcgcccatgccaatggcaaaaccatcaagcgcggcaaggggaatactgcttttcgacgcgacagcctcggcccgtcccaccacgatacagttcgttacgatcagcggaataaaaatgccgagcgactggtacaggccgtaagcataagcattgatcagcatctgaacacagctcaccacggacgcaatgatcatcacgtagatagggatacgaatttccgatggcacccaacggcgcgaggcggaaataaaactgttggtcagggtcagcaccagcgtggtcgccagaccaagccctagcgcattggtggcggtggcggtcaccgccagcagcggacacaggcccagcaactgaaccagcgccgagttgtttttccatagcccgcctaccagcaggtttttagcttcactcatttgcgtctccacactcgggtaacgaagagagttttcccttaagggtttcaattaacaatgccgtccgtttggtggcattgacgacggcacggggtgtaatcgtggcaccggtaaactgatcaaattcgccgccatcttttttaacggcaaacgctttatcgtccgggcccgttactactttgccattaaaactgttgatccagtcagaaatacgcagctctattttatcgcccaggcctggcgtttcatgatgttcaatcacgcgcacgcccaggaccttgccgttaaagtccgccccgaccagcatctggatagcaccagagtagccgtcgggtgccgttgtttccagagcggcagcgacaggctgattgcctttacgcgccaggtacagatgatgagggctggcattccccagcgccgcatcagtgacaacgtaacattcctgctgaatgtggttatcatacatatcggttggcaccacctgatccagcagatttttttgctgtaactgcgtctggtgctcaacggtgggcttggttaccgtattcacaatggcggtaacgccggttgtgatggcggcgaacaacgccagcgtcacgccatttttgcgtatcgtgtccagcatcatttagtccttttgatggccgtaaacacgcggctgagtgtaatagtcaatcagcggtacgcatatattagccagcaatacggcgaaagcaacgccgtccgggtaaccgccaaagctacgaattagccagatgagcaatccgatcagggcaccgtagatcaaacgaccacgatcggtcgtcgatgcggtgaccggatcggtcgcaatgaaaaacgccccgagcatcgtcgcaccggaaaacaggtgaatcatcgggctgttcagtgaggcgggcgaaaacagccagcccagcgtcgcgcagaaggcgagagacagcaagatggcggccgggatatgccagcgaatggcgtttttccacagcaggaacaggccgccaaccaggtaacccaggttaatccactgccagccgagacccgcgagcacgccgctgtaaataggctgagccagcagttgctctgcgctgtgtccggcgcgcaggccggttttaaacgtatcaagcggtgtcgcctgactcacgccgtcggccccgagctgcaactgctgcaaggtgtcgcccgccagggtatgaccggtaaagatcatattcagcgaatccagcatccccggtttgatcatctgcagcgattccggcggcatccaactggtcatctgcaccggaaacgagatgagtaacaccacataacccaccatcgccgggttaaaggggttttgtcccagtccgccgtacagctgtttggcgatcacaatggcaaagatcgtaccgataactaccagccaccagggggccaaagaggggatgcttatccccaacagaatcgccgtcagcaaagctgagttatcggccagattggcagcaaccggcgttttgcgcagacgcagtattgccgcctcggtgagcaatgcggtcagcgaggccagaatgacctgcaacagggtgccaacaccaaagaaataacactgtgccgcaaagcccggcagggcagccaacacaaccagcatcatgatgttgccggtgctgcgacggttatgggtataaggtgaacttgctatacggaaagccatttattcctcaggtgtcaatgtcgattgcgctttacgcgctttggcacgttcgatggctgccgcaatagcggctttgcgcgcatccgtggggtgctcaagttcaggtgcctgttcggcttcggcattcgcattattggcttgttcttgtgccatttctgcctgctcgacgtcctggtgcgcctccgtagccgccagtgctgcatcccgcgaggcggcctctgcccgggcaagtgcggcagcggcttttttggctttcgcacgttcgacggcggcagcgactgccgctttacgtgggtcttcttccgtcatcggggcgtcctgcgccgcatcagcactgtccgccgcagcagcagcctgagcggcttttctggctttggcgcgttcaacggcggcggcgactgccgctttgcgcggatcttcttccgtcggggcgtcctgcgccacgtcagcactgtccgccgccgcagcctgcgcggcttttctggctttggcgcgttcaacggcagcggcgactgccgctttgcgtgggtcttcttccgtcggggcgtcctgcgccacgacagcactgtccgcagcagcagcctgagcggcttttctggctttggcgcgttcaacggcggcggcgactgcggctttgcgagggtcttcttccgtcggggcgccctgcgccacgtcagcactgtccgccgccgcagcctgcgcggcttttctggctttggcgcgttcgacggcggcagccacagccgctttgcgtgggtcttcttccctcggggcgtcctgcgccacgtcagcactgtccgccgccgcagcctgcgcggcttttttggctttggcacgttcgacggcggcagcgactgccgctttacgaggatcttcttccgtcgtcggggcgtcctgcgccgcatcagcactgtccgcagccgcagcctgagcggcttttttggctttggcgcgttcgacggcggcagcgaccgccgctttgcgtggatcttccgccacctcttcggtagtttctggcgcatcagacacggctgatttttttgctttagcacgcgcaatagcggcttcaacagccgctttacgcggatcggtggcctgacggctcagcgcctgagtttctgcctgcgcctcggcctggcgtaaacgtgcctgagcgtggcgagcctcggcgacggcctcttcactttcaacaccttgctgcgctttggcgcgcgctttcgccgcggccagttcaccactgtcgctacgggccacgcgctgtttcgcttcagcatggcgcgcttcacgcgcttgtttttcccgttccagtcgggcctgacgcgcttcaaatcgcgctttggcttcaagtgtgcgtttggcttccaggtcgatagcccgcagctcggctttttcctgacgataatactggaccagcgggatattgctgggacagacataggcgcaggcaccgcactcaatacagtcatcgatgtgatgcgcgcgggctttatcgtgatcgccgcccttgctgtaccagtaaagttgctgcggcagcagtttagccgggcacgcgtcagcacaggcagagcaacggatacaggattgctcctgttcgtcattgcccatttcggtgctggacggggccagaatgcagttggtgatttttacgaccggcacatccagtgatggcagggtaaagcccatcagcgggccacccataataaccatctggcgtggcgagggatgaaaaccgacctgatgtaacagatgactgatgggcgtgcctaagcggctccagacgttacgcggctgggcaatcgcctcaccggtcagggtgactacgcgctcggtaatgggctcgccattgataatggcgcgttttaccgcccaggccgtcccgacgttttgcatcagcacgccgatatcagtggagcgtccgccatgcggaacttccttgccggtcagaattttggtgagctgcttggcaccgccagacggatacttggtggggataacgcgaatctgcagatcgcgctcgccacccagcgcctgtttcagtgcggcgatagcttcaggcttgttatcttcgatgccaattaacacccgttctgcctgtaatacccaggccagaatacggctgccttccagcacttcggctgcgtagtcctgcatcagacgatcgtcagcggtgatatagggttcgcactccgccgcattgataatcagggtgttaacgccgcgcaagccgcctttcagtttggtggcggttgggaagcccgcgccgcccagacccgcgatgccggcgtcatgaatgcgtttcaggatggcggcacgttcgtgctggcgatagtccggcaacggttccagcgagatccaacggtcttcaccatcaggcgtcaggaaaatgcacagttcagacaggccagacgggtgagccgtcatgtgcgggccaatcgcttcaatcacgccagaggttggcgcgtgcaccggcagcattctgccctggccaaacgtcagcgcctgaccacgcagcaccttatcgcccggcgagacaccgatctcaccttcatgaccaatatgctgcttaagcggaataataaaccggtgcggcagcggcaattcggcaagcggcgtgccgttggactgggttttcatttccggcggatgaatgccgccctgaaaatcccagaccttatcttttttgaaaaaattgagcagattaagcatgactctctaccgggatcacccgaacaggaatggcttcaagatcccatttccagttggccgtggtggtggcaaccggacgcatctcaatacagtcggtaggacagggcgccacacaaaggtcgcagcccgtacagacatcactcagcacggtgtgcatggcgcgcgttgcgccgacgatggcatcaaccggacaggcctgaatacatttggtgcagccaatgcagtttgcttcgtcaatccacgccacggtacgcaccggcgctttggcgtcttcgtcaccgtcaatcggttgcggttccacgttgagcagcgccgccagtttaagcatggtctgttcgccgccgggcgcacatttattaatggcttcaccgttatttcccaccgcgtcagcatagggacgacagccgggataaccacactgaccgcactggctctgcggaagaatggcgtcaatttgttcgacaatcggatcttcttccacctcaaagcgtcgcgaggcgtaacccagcagcgcgccaaagaccaggctcagggcgctcaatacagcaacagctatccaaatcgcactcatcagaatttcaccagaccggtaaagcccataaaggccagtgccatcagacccgcggtgatcagcgcaatggagtttcctttgaacggcgcggggacgttcgccagcaccagacgctcacgcataccggcaaacagcaccataaccagtgagaaacccagcgacgcgctgaatccatacagcgccgcctgcaaaaaggtatggttgagattaacgctcagcaacggcacgcccagcacggcacagttggtggtaatcaggggcaggaaaatacccagcagtcgatagagcgacgggctggttttacgcaccaccatttcggtgaactgcacgaccacggcgatcaccaggatataggccatggtccgcagatacactaagtccagcggcaccagaataaggtggttcaccagccatgcacaaatggaggccagtgtgataacaaatgtggtggcgaggcccatgccaatggccgtttccagctttttggaaacgcccataaagggacacaggccgagaaacttcactaacacgaagttattcaccagcacagtaccaacaaaaaggaggagataatcggtcattttttcgcctgattgccacaaagcggcttattatcattgataacgcgttgtatcacaactgtgacacaacattgcctgcgggcaaccgcactcaggattaaacttttgacgataatcagggcatcaccgctggataaacgtcgctttaacccgttccgagcgcttgaaatagggcacaaaaatcgccgctgccgcgagtgaaagcagtagcgtctgcaaggcgcgggcgtcagacaccggcgtaaaagcaaaggtctttatggccagcagaacggtaatcagcagccagacgatatagtggcgcggcagccggtaagagcgtttgaagaatatccagacgacccacatgctgtaagcccacagcagcgtcgcggtaaacagcgaaatggcccagtagctggtgacaagtgaactgtggttaaacagggtggcgcgccattgcgcatcaaacagcggcgtcagatacatcgccatgaccagcgccgtggtcagcagcgtcatcaataaccatgccagcggcagcaaaagccagccaccaatacgtggtgcggcatcctgtgtgttcattgcggttaatcctgtctcaacgttggaagcggctcagaatagcatgttaagaccgaagggaaccaatatgacgatgtatcaataaacgtcattcacggcagtatcagacgacgtagcgccataccgacttaggcacgcagcccagatcaaacagacgaccaccggacaccagctctgcacgtcgatgatcggcggcacggtacatattgataatgtcgatatcgtcagaaagcgaataattcagatggtcatacagtttttcaagactatcgaggttgttcactttgcgaaattttaaaagataatcgtgcgcagtcatttttgtcataacgaatgagggtgaaagaatgccaagtatagggagacaccggactgtgtccagcgccagggcgtaaaaaaagccaaaatcagacaatcgtgagagattgctcgctaaacaacatttttaacgactttagtcctgagtaacaggcgttgccgttatcgggtcaggcgttaaacagatgttatgcctgttacgctaaagagaccaggtaactttttatctgtttatatgcacaaatccgctgttgttaataccggtttgcgtgacctgaagaagataaagacactaaaccctcaacaaacgcttatagcggaatcgtttcattcgatatacaggcccgcctggcgatgtgctggaaatcacaaaatacactttttgtgggcgaataaatgccataactcattatgtacgcctccctgtaatcgttttcaactgcgtcacacttaagcgattctgtttattacatttatttagcatatgttgaaaaaataaacaggcgttttgtccataatgcctcgccagatttgccgccaccaagagcgtaactcctttaaatagctcgattttgtgaagcatgtcgccctaattcagcgttttttacgtcagtctttacaggcactttaccctatacagcaaacgcccttcagaggaataaaaactatgtggaaacgtttactcctgaccacgctggtcagcgccgcattaagtggctcagtgttagcggcggaaatgacggtgggattctcgcaggtaggttcagaatccggctggcgctcggctgaaaccaacgtggcaaaaagcgaagcaaaaaaacgcggcattaatttgaaaattgccgatggacaacagaaacaagagaaccaaatcaaagctgtacgttcttttattgctcagggtgttgatgccatctttatcgcacctgtcgttcagacgggctgggaaccggtgttggaagaagcaaaagacgccaaaattccggtttaccttctggaccgcgccattgttgttaaagacaactcgctgtatcaggctgtggtaacggcggataacgtgctggaaggcaagcttatcggtgactggctggttaagaccgtgggcgacaagaagtgtaacgtcgtagagctgcagggcaccgtgggtgccagcgttgccatcgatcgtaagaaaggctttgctgaagcgatcagcggtcatccgaatatcaaggtcattcgttctcagtctggcgactttacccgcagtaaagggaaagaagtcatggaaagcttcatcaaagcagagaataacggcaaaaacatttgcatggtttatgcccataacgatgacatggccatcggtgctatccaggcgattaaagaagccggtctgaagccgggtaaagatatccttaccggttccattgacggtgtgccagacatctataaagccatgctggcaggcgaagccaatgccaacgtggagttaacgccaaatatggccggcccggcatttgatgcactggaaaaattcaaaaaagacggcaccttaccgccaaaaattatcagaacagaatcaaaactctttttacctgctgacgcgcaggcagagttagataagaaaaagaacatgggttactaagccgcaggccgcccttcggggcggctttctatgatgtagtgcggagttgacagcatgaccacacacgacgaacaccctcttttagccatcagcggcgtcagcaaaggcttccccggcgtgaaagcgctggatgatgtctcactcagcctgcgcaaaggcgaaatcatggcgctgctgggtgaaaacggcgcaggaaaatccacactgattaaagtcctgaccggcgtatatacccgggacagcggcacgatcacgttaaacggtcagtcgatttcgccgcgcagtaccgccgaagcccaggagatcggtatcgggacggtctatcaggaagttaatctgctgccgaacatgtcggtggctgacaacctgtatatcggtcgggaaccgcgccgtttcggcatgattgaccgtaagcgcatggttcgcaatgccgatgccctgatgcgtaattacggttttgccctggatgtcacccgacctcttggtcactactcggtcgcgatgcagcagatcatcgccatctgccgggccgtcgatctctctgcgcaggtcctgattctggacgagcccaccgccagtctggatgccagtgaagttgaaatgctttttaccctcatgacgcagctaaagaatcgcggcatgagcctgatatttgtgacgcattttctggatcaggtttaccgcattaccgaccgcatcaccgtcctgcgcaatggtaaattcatcgccacgcatgacacagcaaccctgccgcagattgagctggtaaagttgatgattggccgagagctgatggccaccgcattgcaacggcagggcagtacgctgcgcagcaatcagcctgtggtgtcgtttgaagactacggcaaaaagggcactatcgagcccttcaacctgcaggtcagacctggtgaagtggtggggctggccggattgttggggtccggtcgcacggagacggcagaagtcctgtttggcattcgtcgcgccgatcgcggtacggcaaaaattaaagggaaggttgaacatattcgcacgcctgcgcaggcttctcgccttggcatggggttctgcccggaagaccgtaaaacagacggcatcatcggcgcagcctcggtgcgtgagaatatcattctggcattacaggcgcagcgcggatggttacgtcccattaaaaagcgggaacagcaggccattgccgagcgctttattaaaagtctgggtattcgcacaccgcacgcggagcagcctgtggagctgttatccggcggtaatcagcaaaaggtcctgctgtcacgctggctggtgacgaaaccgcagtttctgatcctggatgagccgacgcgcgggattgacgtgggcgcccatgcggaaattatccgcttgatagaatccttatgtgccgatggcctggcattgttggtgatttcctcggagctggaggagctggtgggctacgccgatcgcgtattgatcatgcgtgacctgaaacaggtggctgagattccactggagcagctttctgtggcggcaatcgttaacgctattgctgatggaggtacgcagcatgcttgaatccccggtcaccgcgtccaaacctcaacgtcgcaagttcaggctgccgcccggtatgccacagatcattgcgctgttactggtgctgatcgtcgacagcctggtcgcgaacaacttctttgccattcacttacaggacggtcggctgtttggtagcccgatcgacattatcaaccgtgcagcgcctgttgcgttactggctattggcatgacgctggtcatcgccactggtggcatcgacctgtcggtgggggcggtaatggcgattgccggagcgaccgccgccaccttgaccgtcgccgggcacagcgtgccgtttatcattatggtcacgctggccagcgggctggcgtgcggcatatggaacggcattctggtggcattactgcgtattcagccttttgtcgccacgctgattttaatggtggccggacgcggtattgctcagcttattactcaagggcaaatcgtaacgtttaacaacgacagcctgggctggtttggcaatggttcattctggttattaccggtgccggtgtggattaccgtggcggtggcgctgctggtctggctgctggcgcgcaaaacggcgctggggctgtttattgaggccgtgggcatcaacttgcgcgccgcacgtaatgccggggtgaatggctggctggtggtgatgtccacctacgccatcagcgggctctgcgcagcggtagccggcctgattgtggcggcggatattcgcggtgcggatgccaataatgccggattgtggctggaactggatgcgattcttgccgtcgtgattggcggggcatcgctgatgggcggtcggttcaatatcgcactgtcactgattggcgcgttgattatccagtcgatgaataccggtattttactgtctggcttcccgccagagctgaatcaggtggtgaaggcgatagtcgtgatgtgcgtcctgttgctgcaatccccgcgctttattgcgatgtttaaacggagacgtccatcatgattaaacgtcatctacctttaatgatcacactgctggtgtttgtgatgggctatttgttttgcctgagccagtttcccggctttgcctcaacccgggtgatctgtaatattttgacggataacgccttcctcggcatcatcgctgttggaatgacctttgtgattctgtcgggcgggatcgatctgtcggtgggggccgtcatcgcgttttctggcgtgtttctggcaaaggttatcggcgattatcacctcaatcccgtcctggcgttcgccctggtcctgagtatgggggcgatgtttggtgccatgatgggctggctgatcgatgcgctgaaaattcccgcatttattatcaccctggcgggcatgttttttctgcgcggctgcagttacctggtctctgagaattctattccgatcgatcatcctctttacgccacgctgtccagcatggcatggaaggttccggggggcgggcggctcagtttgctggcgctgatcatgctggtggtggtggcgggcgggatcattctggcgcaccgcactcgctttggtaatcaggtttatgcgattggcggcagcctgacctccgcgcaactcatgggcgtttcaacccgcgccaccaccattaagatctacatgctgtcgactaccctggcgacgctggccggcattgtgttttccatctatacctcggcgggctatgccctggctggattgggcgtggaactggatgcgattgcctctgtagtgattggcggaaccttactctcgggtggcgtaggcacggtgctgggtaccttgttcggcgtgttaattcaggggcttattcaaacctggatcaactttgacggcacgctcagttcctggtggaccaagattgctattggcattttgctgtttgcgtttatcgcgttacagcgcctgctgacggtaatttgggatcgtcaacggaacgcgccggtgaaacggctgattcaataagctaagggcggcgctgatgcgccgcttttttgagtagcaggtggcgcaacccataatcggtaatggtaggtgagagagcgtgagtgaataagcattgcctcaacagggattattcatcgtgcgggtgcatgcgttgtatcacatcatgccagcctgcatgctttctcaatcacggataaagcatgtccattccttctgcgttatgtcggtttattattgctagcaggtcataacgcatttgcaatgaatgcctgtcctgtacgtatttggcctgttccagaagacgttaacgacggcccgcctcttttttcacggcagaataaggttaatgatggagaagagggtgccagcggtataactgcgtcaccggattgccagtctggcaagcgctggatttacgcctttatcagcgcgatgtcgctgattagcgagagtaagagggtgacgtttagccgtgaaacgctttgttttttccaggcagtgctaatatctttgaaataatgatggcaaataacagagacctgctgtgggaatgaataaaacctataaaccctcgttaaaagggcttctgtgcctgcattctgttggttgcatagtcattactgcactcatgctgatattggtggtgggcgttgttcttaaggttctgactgaaaaaagaatcattgaatctaacaccgcctatgcccgtaagcttgctgatatggccgacagtacattcagaacggcacaaaaagagcttgcatacagtgccactcagattaaacgttttgaagacaaacaggcactacagcaagaagctgacagattaagactgcaatcggatatgttcagttcagtcgtgatgctaacgccagacggttacgttgcggcatcctctccaccaggtttactgcctgttggtacgtctttgaatgttgcccctgagcagttgatggcggtaaaaaagggggcgttcgtatcagaaccctttacaccttccacaggtaactatctcatttttttgtcgaacccgatctattcctcttcgggggcgtatctgggttatattgcaggatctatctacctgaaaagaaaaagtattttaagccgcctcatgagccatcatttttacactgataaaacaacgatcagcattgtttcagatactggagaagtcatttattcacctgatgagatgcttacaggaaaaaacaatcctttgactaccagcctgacgacgcggctgaatcaggccagcagcggtggattaaagacaacgttagaacaacgcgactgcctgttaggctattcagacgttatcaaaaccaactggcacgtattcgtatgcgtttcgcctgacgtggtcagcacgacactcacgcttatcgctaaagatgtgttggtttatggactggtgatagcattgctattggtcggtgtgagcatctttgtttccacgcagatttccaaaccgctcgaaagactcgctggcctgacccggtctactacaacgaaggatttgcctcccaaaatcaagggtataaaaacgtggtataaagaatctgaccggctgaaaaaatcttttttggcttattcgaacacaattaataaaacgttggccatattacgtgatgatgcaataaccgatcatctgaccaaactgtataaccgacgtggatttgagcaacttaccgcgccttacctctctgctaaaaacgaacatagtcttgcctctttcgatatcgattactttaagcgcattaatgatcactatgggcatgatatcggtgataaaacgttagtggccgtcgcgatgtttttaaaaaaaggctgccgcactaacgatattgtttgtcggtttggtggcgaagaatttgttgttttctttccgaatacacaaatctcagaggctgaatctattgcaaatcgtatccgtgaacatatcgcatgtgcgcaatttagcgaagtaggaaaaatgacaatatcagctggcgtggagagtttagctcaccataacaacgatattgaggaaacattgctttccgttgaccaatggttgtaccaggcaaagcatgaggggcgaaacagagttgtttctgccagaagtaaactgatttcgtcgtaaaaaatgcactgcacgacgtcaagattatcaacattgagatctcagcgtcgtgcagtggacaagggtgaaaaatcgttaaaaaagctaactacttctttcacagacgaaaagtggcgtagtctcagagtaaaaaagccaggctttatcaccgtaaggcctgattttcagcagcagaggcttccctttttcaataaagaaatcaggtagccattttctttgatcctgaacgctcatggtcatttgtggcgagttgatgaccaaatctgagttaaggtgataataatagccctgttctcgataggagaaagatatggttttacttaaataaccatcgcctttatttttttcatgaagcgtacccgagagagccagtatccctttgccattctgaatgttttgagaaatgaataaatttagcgtgctatcttgccactgataagaaatatccgctttacacgatatacggtgttcccggtttccactaaatggatacaataaaagagcgataaagcatagccctgtcagaaccagaattttattcatcattgaaattcttaacataataatgagagagacagtttgctcgaattgtagcgtgcaaggggtgctggcattgaaagtaagagagtctgtcagcatttttaaaagatgtcatatagatatattgactgtctttacaattgatatccaaatcatctacgcgtttttttaactcagcgctattgagccaggcgtctgagttattaaaaatcacgcagcctttatagtccatgctgtgagcgaaaacgggctctgccgattgcggttcgactttgataaaaataaaaatacagcaaaaagaaacgaaagtgatggcggtaaaaaacacatttttaaaagagagtcgtgctaacaacatttctgttttgggtaaccatggcgagtgatcacgttgacgagttgagggtaaaaccgtcttatgatctttatcatcttcgacatctgcgtgctgtaacacggctggagatgctccctcgtgggattctgtgttttcttctgacgaaagaggttcataatttttctcactcaagacagctgctgaagaagctgtaacggtattttctttcatcaccacggtttgtggtgacaggataaaaccacgccggggcatcgttcgaatgatgtcttcctgcagtccggctttactcagtgcgcgcctgaggctggatatattctgatagagggacgtagaggtcggctccatgccaaaacgacgccatgcatagtcaaaaaactgttgatgagtgactaactcaccgacattttcaatgagcaactcgaagcatagtgatgctgaagcactaatgatcgccggattgcctctgccagtaattctttttttctcgggttcaaaaaccagaaagtgattaagtgtaatctttcggctcaaagtgctctccatctgtaccaaaagaaatggacatgaatacccatctattgaaaggaattaatagataaaaatttgttatctgaatcgacatcagcatagtgctgaataatttccaaatcaaattaaataaaagagttttatttgcatgcctttgtcttttttaatttaagtggaatataaaatacatgatttaagttgtaagtaattgattttattgtttataattttaaatttaatttaataaaaaatagtaatgtttttagagggaacctgaagcgggtttaggcttcttatgtagcccgctgtcgcacgcgaaagacagcagataacgatgttaaaacgcgcaattaacttctcaaaaatttctctaatagtaattatatacattctcatttgccctgtcagtcaggcgttctggtcaacggcaggtgtcagattcatttgaactctcattggtttacgcgcttgctgccgttcactgcatcattcaaaatagacgttgttgtcagcatacgcactcatatgaaaaacgcacatacatacgtcttttaataagccgtcagcgctatccacatcagaggtaggcgtagctgcatgcgcgcaatcctcaggtcgcgcagacagacatcatgcgaccaggggggttgggcgaggataaaatctgcaagaaaataatgtgcagggttgttaaaccaaccagattaagcccagattgcagactgagcggaacgaatacaccctccattttcaaagaacctctacctcaatgatactcatcgtcactgcagcctgagatcacgcatcagccgttgtttaagtaaatcacgcgagaattccaggtgggcatcacagaatcttacgttgcttcgtttaacgttaaggtattgcatttcaatggggcgttgatgatgtttttaactgccctcacttacctgtgtcattctgtatttatccatacctgcgacattatggcttagcaacgcatcgtagatatcatgtaatcaatatcccgctgtaacaaacaccactctcatcgacctgacagaatgtctgtcgtttcctgatctcctgacgttaagtatcgaaagtgcgcaacccaagcctctggcccaatgttctaagagcgtcacggtttgcacagcactttctttttcaaacatattgctgatttaacggggaggtaggataaaacggtaagcttttctggtacgactatctgactaaaagatatggctgtgagtcaatgtaaaccaggaatgaactaaaggaatgaaaatggtcaggaatgaaacatcttaagtaatgcattcaggtcgagtgaccaacgacaacgtcaggctgaacgtttgtctattttaaacgtgattagtagggcaatgaaacagcgtcaatcagatgtgacggcatggcgttgtgtgtactgacgcttcgacacagaaaaaagtatgaaaagggactggaaagggcaggctaatccggcaggtgtccattgcaatctttaaaagacgagttttcactcagtgataagtaaatattgggagttgatgtgtatgttcttttctgaatttatttataaatcaatcaaaaaaaatattgctttaaatgtggcatagagtatatgtctatcttattgatttttaacaataaaaaacaaaagattattttataaaaaaagagattaattcatatggcgatttcaatgtttaacgttatatttctcaccgcattaagcctgagcggcttgtgtcgattttttttatacagagataaggaagaataacgtgtcttttaataaaacagtattagcgttgagtttcaccaccagtgtattattttgccattcagccatggcgggaaccgacattaatgttcatggcatcattgcgccgaacgcctgtacagcaagtgttgtaggcggtgaggctcttgactgggggattactcagcacaaagatcttaatcaaaccgcggtcaatacctttgcagcgaaacaagtgacattacaggtaagttgtccctcagcgcagaaagtggcattctgggcgaccgaccccaatgaaagcagtgctatggtgggtgtgaataccaataacagaagtgggcatgcagatagtacgcgtatttttggtttagggatggatccggtaacgggaaataaattggggaattttaccatcagccctgtttcatcaacggtagacggcgtgaccaatacgacctctttcggttaccagaatagtggttcgcacagtggtactgcgtttggtcgtgtgttaaatgccgattggagttataagaaaacggaagactggacaccatgggatgaaacgaccagtgcaccagcctcagggaaagatatttcatgggtgtttgacatcgaaccgcaattaaacgccggaaatatgataacgaatgcgcaacaggttgactggcagggtactgcacagattaacgtacgttatttttaatttattttttttgagagcgacagcaggcatctccctatgaggtgcctgattttgacatgcaaaaaatatattatgttgttactgttattttctttttaatttttacagcaccagtgcggagtgaaacgctacattttgattctaatttgatggctgcgaatggtatcacttctgcgcagcttgataatgcacttaatcagcatgtaatgccagagcgagaaacggaatctgatatttacatcaatggaaaatatattttatcaggaagggttttttcggttaaaaatgcagcggtttattcggaagacataaaatcaaaagcaggaataaaagcgttagcatggtcgccctacaaagccagaaatggcagtaaatatttttatctggataaacagattcaggctaaatttgatcgggctaataataccttacggttattagtccctgtaaaatatctgattaatccagaggggaagcaaaggttgagtggcgggaacggggcatttataaattacaatacctatgcctatcgcttttcaggaggagaaacctccctcaacagtatcaatacagattatgaagccggaattaatatgaacaatacgattattcgctcacatggttactacagttcctttagcagccgtaacgcacgtacggcggttaacacgatacgtgatggctatattgagcgagactatcaaaatgttcgcgtccgcgcaggacgaacaatcgttagcgatggtgggtttggcactggctatattgatggtgccatcatctcctccgccaacggcaacgcgacggcatttgtgaactttaattatgaagctgcagaaacgctgactgtcgagttctggcaaaataacttgcttctctggaaacaaatcattcagaaaggccatgcggaactgcgtaatattccggtagctggctttagtgatgacgtcagggtattggttaagcgagacgggcagatcgttgactcgcgcatcatctcacgcgcgcaaatcacctctgaccaggatggtaacgcgggctattatgcttttacgggacgtaccgttagcggcagcagaagcacggtaagcggcgccggtttctccagaacgctaaattcaatcttcgccccatcggtcgctatggtcactgcgtcaggctatcgcgggcttacggtcagcaatacggctttcgaaaaagattttcgctttcgctccagcctgacaagcgtacaaaatgagaaaaaccagaagggcctgagtttggatgtttcaggcagctataaaaataccagccttaattttagtcgtaacagccggcattttagctatattggccaggcacgactcgggaattacaatgcacagcggagcagcattggtttaacgcagacgcagcagttttcctatggcgtgacaggaagtatctcgttaacacattatcgtttctacgatgcgcctggtttcaattcattgtcaggcagtctgaacttacctgtgggaaaagcttcgttgggcgtaggtgtctcctacatgtctttaagccccggacaaacgcaaaaagataagatcagcctcaatcttttcttgagccttccactaagtttcaacaaacacagcgctaactggcgaagtcagtattacacgtacggtaacagagcgcgcctgtcgaattcgctcagtgcgccggtatctaaaaactataccgtgactgccagccagatgcgtacgtcgggcgcgggtcggtcagaaagctactcgctggataatgccgtcattacaccttacaccactgcggatgtctcgctctcccagggacgagatgccggaggcgtatcgcagaccaccgcggcatatttatccggtgctgttgccattagtaaagaaggcgttattttctcaccaaaccgtattggcaatacctgggcggtggtcgacacaggcgtccatcattatcttgatgtcgcctcattacaaagtagtgcggtcaccaatcatgatggaaaagccataattacgcctgtcgctgaaggacgaaatgattttattcgcgttagcccggaaggtctgccatcaggtgtaatcattaaaaacaacgtcagagatttttcagctgttcgcggatcggtgccgttctttaaatttggcatagcggataaccgttcaatgctgttgaaatggagccacaaaccttctgacattcatcagagtgatcttttttatgacggttctggaaaattaattgcccgtttcatcgacaaagatattcttttaatcgatgaaaaagatatcggaaagctggaatcagaaggtatgtcgtcacctacgcatttaaatatgcaatgtaaactttcatctcgtcgtctgaatcaacaggagagtattaaaaatgttattttcaactgccatgcttcgtaacgtttctatgagtgttttcatatttacaggtcttattcatgatgccagtgccgaaattctaccttcatcatcagcggtgttgatcgagtcaggtaagcaggagtcgactattgatattaagaataatggcgataaaagtgtgctgctttacagcaaaatccggcgtctaccagacgataatcttgccggtggcacactgtatactgaacctcaggctattgtaataggtccgggcgacatccagagcattcgggtaatttaccgtaccaatacgccggatgtaaaagagcatatcgcgcgcgtcgtatttacaggattaccacctaaggacgaggtcagcgatggaaaggtgaaaattctcattgggcaagatctgccggtcgtagttaacgtcagaaaagatatcgagcaaaaagatatgtggcagcgcgtacaatatcagttagtccgcggcgatctctgtataagtaatcccagcgctaaagtgttccgtttctcacctttggttaatacagatgaaggcggatcgaaaatcacttttacgaagccttatgttcttccgcaggagacgttgtgcgctacaccttctcatccactttcaaagggtatgcatctgagcatcaccagcgtcagtgattataattatcagttaaaaacaaataaagtcaccctgtagtttattgcaggcgcgcctttgaggtttactgattcgctatggagataacatgtgcttagggttatcgggaaacatggagaaaatgtttttttaacggacaaagaaattgccgtaatagggttttacatgaccggaatgaaattacagcagattgcgtgtcggacaggcatggatgtgctgaaaattcgttaccacaaacgcagggtgatgcgtaaattaggtgtgaaaaacaataaggaacttattctctggttcatcgccaaccgtccctcttttagtcttgaggagagggagggttagtgcaaaacgaggattcatccaattaatgaccaacgggtgtacgtggtttgaatattttggcgaacgctctcggcactgtgccggcgatatgccttcctctccgcaatgtgagtgggcaggtgcagggaaggtttatggcgttggaggcggtgctggcaaaacgttgcgaggaaaagggggcttttggccgctgtaggggggaaagatattgccggaggattctgcgcctttctgtaactggcggggatgagttacagacaggcgcagataataccctttctggttgtgtaacgtcctaaaattgttatctcaatgttctgagctgaacgctttattgaatataaaaatagcgagaggctaataaaaaacagtacatccgatattctgagaatggaaatctgttctgtgtggcttcgtgcttagggtttctatcaattagacgcggcgtttttagaaattatgatgccgggttgaggggggcatgttaatccggtacgtacaatccggaattatcttagctagtcgttcactgaatgccaccaggttagggaaggtggcatttttatatggcgttgggatgatgaatgacaggttgggatttgaagttgattgttaattaaatatttttttggttatttgtggagagataaaaaaattattgctccagtggaggggttgtgacttttatggataatgcaaaacgttgtctgacatttactgaaaatgaagtggcggttacctggttttttatgaccgggatgacagtaaggcaaatagccgaatggatgaatctgccggagaaagcagtcagttattataaacggagagtgatgaaaaaaatcggcgtgaagaatgataatgaattcattatgtggtttttggaaaacaggctttcttatcagaggagcgagattgaattttctatcctccgtcagaataaaagagcgatcaggataaagtaaatgttgcaaaaagatttaattgatatgggaattaaaaagaatgcaagatgcatccttaccagcctgtttttactgttatcacttacaggttgtagccatagcatttcgtcaaaagcaaacaggcaagactatacgctgagccatgattattcttcactcgcccaaaacgaacgtattcgtttcctggtttttcattacacggccgctgataacgcaacatcgttaaaacttcttacaggtaataatgtcagcgcccattaccttattcctgagtcgcctgacaatacagcagataaacccctcatctatcaactggtccatggagataagcgcgcctggcacgccggtgtcagtaactggaatgggcgtgtcaatctcaatgattcttctgtcggtattgagattgttaatcgtggtttttcagaaaatatgttgggacataaaacctggtatccctacgatgaaaaacaaatcaaggcgcttgtcgcgttgtccaggcgcattatccagcgttataatattacccctgataacgtagtcggtcatagtgatatcgcccccctgcgaaaacaagaccccggtaagctgtttccctggaaacaactggctgctcaggggatcggggcctggccggaagcagagaaaataaaaaaatatctcaacggtcgtctgccaaccgcacctgtgaatgttcataaaatgcaggtgctacttaaaacctatggatatgatgctattccacaaacgggtgtgctggacgaggagactataaaaaccattcaggcgtttcaaatgcacttcagaccggcgcttgataacggcatacctgatgcggaaacagaggcaattgctcaggcgcttaacgaacagtatcgcccaaaggccattgattgaagggatcatcaactcaaggccaggcagcgactttgagcatcgggctgttacgcatgccaataacgcagaggcggtttgctgggtgggcggctaacgggcaaacgttatgtttaggctgactccttataagggctccagtcagtttgttaacggagccagacggcgattcatatcgcaattttcccgtgttggctgttgtggatttaacacctggtaaggcatgtggcgcgtttctcctttactcggctttgccttaaatacgtcaatctgacgggttgagggcaggagccagtgcgattgttcgttttcacgcccgacatgcttgcaagcgatgcgcgttcacctgtcaggcttgcctgcaccatcacattttccaatgacgcgtcatcttgtaacttctcaactcgcatgacagtatcgttacatgtatatacatgtactaccgtttacgcatccatccgttcaacaataggtctcaacgcaccgcgtatgctgtattccagtgaggaaactatgccagctgaatcacctgcagcagattattcaggcgcagagaaaccgcgcctgtcagaaacccgttcgattgattacatcccgccgcgcgaacgtcacgggcagcctttcagccagtttaccctctggtttggcggtaatctgcaaatcaccgccattgtcacgggcgcgctggctgtggttctgggcggcgatgtggtgtggtcgctggttgggctgctggtcggccaaatcatcggggcgggcatcatgtcgttacatgccattcagggcccgcgcctggggttaccgcagatgatcaccagccgcatgcagtttggtgtattcggtgcggtcattcccctggtgctggtctgtataatgtacgtcggcttttctgccagtggtacggtgctggcgggacaggcgctggcgaagcttattcacgtcagcaacgcgaccggaatggtggtgtttagcgccctcattgtggtcattgccgtactgggttatcgcgtgattcatcagctaggaaaactggcgagcgtgattggcgttttggcttttgcctatctgtttattacgctgctctcgacccatgacttaacagcggtatggcagaaccggcatttcaccctggctaacttcctgttggcggtgtcgctttcctcctcctggcaaattgctttttgtccttacgtctccgactattcgcgctatctgcccgccaatgtctctgcggtgaagctgttcagttcggtgttctttggcagcctgtctggcacacaggcttcgatgagcctgggagttattgttgccgcgattgccgggaaggcgttttcaggcaatgaggtcggctatattgtgagcttaggcagcaccgcaacgatggcgatggtgatctattttgcgatctgctttgggaaaatcacctttaccaccctgaatgcctacggcagctttatgtcgctgacgacaattgtatcgggcttccgccagcaaacctcgctcagtcggggggcacgcgttctgtttgtgctactgatggtcaccgttgcctgcatcattgcactgctcagtgaaccggccttcctgaaatccttcacgcatttcctgctgttcctgctggccttctttgtcccctggagcgcgataagcctgactgatttctatctcatcacgaaaggcaaagtggatgtcccggcactgtcaacgccagacggacgctatggccgctggaactggtccggtattacggtctactgcctgggggtgatggtgcagttgccctttatcgataacccgttacatcatggttctcttacctgggtttttgccggcaatgacatctcgtggattattggctggttggtgacggcactgctatggctgatcgccagccgatgggatcgccggggtaaactggcgcgttcaatctacccggctgaataacagggttagggccgccgggcagggcggcggttactgaccgctacgggttaatgcgacttgcatttccctgaccagccactcccgcagtgccgccacgtcaggtcgatccgccatatctttcatcgtcaccagatagtaattcgcgcccggtaagcatgacccgaataacgtcaccagcatgttacgtttaatcagatcctccgccagcagcttgctggcaatgaccacgccttgccccgcaaccgctgcctgcagtgcgtgcgtttcatcactgaaatagagacctttgctgatgttcaaactggacggcccatagcggcgtttccagtgcgaccagtccggtgattctgtcggaacatggcggttttcgacgtggaaaagcgtgacgccgagaagatcgccgggcgcattcaacgccagcaacgggctggctaacgccacaaaccgatccttgtagagcaaagtattgtgcagctcatcttccggggcttcacgatagcggatcgccacgtccacggtgcgctgggttaaatcgaccttttcaacgctggtgtgcagatgtaagtcaatgtgcggaaattgcgccttgaaatctgccaggcgcggaaccagccagttggtcagaaaattggatgtggtggtaatggttaacgtcggcggccgtcttgcccggtcaatcttactgaccgaggtttctaatgctgtaaaggcggactgagtgcccgcatacagcagcttaccggcttccgtcagcttaacgccctgagcattgcgttcaaatacccgacattcaagcgtcgattcaatcaaacgtatctggtggctgacggctgtcgcgctcacgttcagcgttatcgcggcctgcttaaagctcagggctgacgcgacggaatgaaacgcgcgcagcgcaccaagcggcggtaaacgggatggcttcatgatgagttattttcacctatggctgaaaactatgactttgattcccttgcagcacagaccgtaagcttaattcattactcagccacgatgaatttaattttatgtcatctgttattactgcgaggcttgctatggcgattttcactttacctgaatcagattctgttactgaagagggaagaaacatcacgtctggtatcctgttaagtctcctggtcgctgagctggtactgattttcagctttgccatgacgcaaggttttattgctggggggatggggctaagctcgctgctggcttcattcttctttggcactatgctggccaggctgggcatcatgaaacgtcagcaggttgtcactcgtctttgctatgggtttctcctggctgcctgtggtttagtcttgcttataatcgcctttcaaaaccctcacaatgcctgcctgctgctgcctggtgtgggtttatccgggcttggacaaggctgggtggctgaacccttgaagcgccactggaaggagattcgccccagtggtttacgggtgtcagttatggtgctggcaatgatcttcagcagtgtgattatccttctcgccagacactggggcgggtttacgggggcgactgggcttttaacagacctggcattgctgggtgggttgtactgtaaaattattcagcaaaccggcatttcgcggtaggtacgagagcgttatcactcggtttgcacgtttttgcttagggcgctggcggccgttacgctgatttgtgtctgcaactgagcagtcagcggtccgcgtatctggaagtcagcgcgagatcccaatacgaatggatacgttattagccagtaagagcgtatcttcttgtcaacgcgcctccacttctcgctcaaaactgccggcgacaacccccgatcgctgaatgacgcattcagacatatcggctgttcaacttaaatgttattcaggacaggcgccgagcgagttcagtcagaccgactgtttgtacaggaaagtccacagaaaattagcgtcaggcaataaaacgacgctgaaacaattgtactgttaatattgctgcacaattaatgggatcgtaacttctcaattgcactgtcgcttaggttgagtactgatttaacgctagtgtttatcctgtcaataatggcctgccgtgggccaagatgccattcttcactgttataaaaagattcctgagaagattttagagacgagagactatcataagctctgattagatagtaagcgtcgtcgtcatgagctgagttaccaaaagaaacaatatccatacccgctgaacggtgaagtggagcgctttcttctgtcatgattctgtggaagtctttcccggtaccgggtttgagggtgtacagcaaaaattcgactgctttcatcatcaatatccttttttcatcatggtgaacgattactttgtaaagcagtggaacctgacagaatggacgtgatgttcagactgacatcgcgccattacttagcaatgcccaaacgaattcacagtgccaggcccgaagacggcaactggcttacttcagatcaagggattgaataacagcagccacttcaggaatatcactcgcagacaggggaaggagaggtcggggcaggcagtcaacctcggtcagccccagcacgcccgccgccgctgccataacacggatgctgcctccgtgtttgcgaaacagcgcccatagcggattaaggcgctcgccgagctgcgtaacccgctcgtgctctccgcgtgctgctgcgtcggtgatttcttttgccgcatgcgggaacaggccgccgcagacggagtaccacacgtcacagcctgcgttgagtcctgccgccgcactggcgtcgccgctaatgccaaccgttacctctgcaggcagtttttccttcaggcgttggacgcgtgccagcgcctcctccggcgaggccggtacgcccgggattttaacggattgaatgccaggcagcctggcgatacgtccgtgcaattcgtcagagaacgtaaagcgcgttgtacttggattatcatagatgcagaccggcactgaagtgtgctgcgtcagggtctcaaacaagccaaaaacctcattgtccgtcagcgtctggtacgaaactggcggcagcagcagcgcatctgctccggccgcctgcgcgtcatcggtcagccgcattacctcatcggtgctgacggcacccacgcaaaccatcaccggaatcgtgcccgcatacgactttgcaatgccagctatccggctacgcgcctggcgcgtcaggtaggcataactgcctgttgatcccagaacgccaatcgagtcgacgcgggccgacgtaatgcgttcaagaaggcggacaaatccacgttcgtcaaaaccattgcgcgtaacaggagtaagtggaaaagcgctcaaaccgtgaaacataggttattcctccagaataaagataagtttgctgctatccgacatcccatttctcagcgcgcctacgcgctcaccgtcatggtaaaaaccagtgtttcatcgcctgcgcaggcatattaacttttttgttcactggtcattatcgtgatttaaaacggtcattacaggattattttatgttccccgctcatccgtcaatcagccctgacgttgcacgtctcgcgccgggcttccgtgcattgagtctcagtgtgctgctccaataacaaatccccgtgtgggagaagatgcactgcgcaaagccttcgaggacgtggttgtgtaaactgcggccgggaagataacctgcgtatccgcgtctcgcgcaaagggttgttggaagatgaaagcgctttcctgtcaggacgaggcgcacgcaggtaaatgcgccaacgaacccgtatcctccctccgtcacggcctgcttcggcctggcacctacactgtatttttataaaacaatgtggatgtctgtctaaagtgcaaggcatacagcgcattgcacgtcatattggtcgtcaatttttaacctgtcgcacacacaaacacctggccgttgaccacggattcatcacctgtaacgagaaaacgcacacgccaggttggaatgccgatattctgcgtgttctctgaaaaggtcagctataaataacgatttcagtaggttgctctgattttcttagtcaaatatccgtttcttttgaaggtttttaactgtccgacacggcagcgggtcaaatttttcataaactgatgtacgtaatcatgtaatcctcagataaccgagagaacaacggttactgattttagtgacttgtctggcaactgaatgttgtcggtggaatggaagggaatatgatgtctttgatttttggtgagttatcgggtgcgccagcctgggtacctgcagtattactcgttattctctcattaatagtggggtttcttgctcgatttattcttctcaggtttatccgttactggcaaagccgcgacagaaagttattcaaatcccttgaaaagcaccttcgtgggtccctgtttctttttatccctttagtgttaatcaatatcggggtgaattatatcaatatccccccgcaatcccttaatttcataacggctaccgccaatatatttattattttatccgtctgctctattttgattcgattgacgaatgtcgcacaggatatgctttttatacgctatgacattaatctttcaaataaccttcgtgcccgtaaaattcgcacgcagttaatctatgtaaaaaaagtggcaatcgtcatccttgtgtcattctgtttgtctatgattctgctcagttttccaggcgtgcgtaaattcggcacgacaattctggccggtgccggagtagcagggatcatcattggttttgccctgcagaagtcgctggtcaacctgtttgctggcatccagatcgcctttacgcaaccaataaaaattgacgatgccgtggtcgttgaaaaagaatggggatggattgaggagataaatctgacctatgttgttgtgcgtatctgggatctgcgccgactggtgctgcccattacctattttacagaaaatgccttccagaactggacgcgtaataacgcacaaatattaggatcggtgtttctttatgtggattactccatgccgttggagccgctccgcagacattttgaaaaagtgctgagcgaaacaaaactctgggatcaacagactcaggtgcttcaggtgaccgatacgaccgaaagaaccatgaccatcaggttattgatgacggcacagaattcccccacagcctgggatttacgctgttacgtacgggaaaaaatgattgagtttattcagcaaaattatccgcagagtttgcctcatgtcagggcaaccctgaccgacgccgatgcggtagacaaagaagcccgctgctaatcgcgtatttggggagagtggaaggtacagaggtgctgctcgccgtataagcgtcaggacaactgtacttctgctgtttgtttacatgcgtagtggatggcatgattcgatgatgcaaaccggacgcatcattccattctgtttttaaggggccctatgaaacacaaatcgatctatcgcgtgggtgactgtgaggtttttaaagtgcctgaacttgaggcctctttatcggtaagtatgctctatcctgaccagccactggatagcctttcccctgaaaacatctcgctttcggtgcatagctggattgtccggacaccgggcgccacccttgtcattgatacagccagtggcaacgggcgtgagcgtcccggatctccgctttctcatcaactggatacaccttatgaacatcgtttccgcgagacgggcattgatcccgatgaggtggattttgttttgatcacccacttgcacggcgatcatgtgggctggaacacccaccaggtggaaggcaagtgggcgccgtttttcaggaatgcgcgctattactgttccgatatcggtctgaaaaactggcaaaacgatcctgcaagacaaaccctgttagaggacagcatcaatccggttatcgaagctggcttacttgaaacgctggatatgacgacaaaaccgatccttgctgaattattacgctttgtgcccacgcccggtcacagccacgatcacgcgtcaattattctgcacagcgcgggagaatatgccttatttaccggcgatcttatgcataacgaacttcaggtcaggcaaccccatctggcctctcgcttttgtgcagatgccgaccaggcggaagtgcaacgccggtgggcaatggaatgggccgccgatcatcaggcattatgtttcagttcgcacttcgcccagtcgtctgcgggttatctgaataaaaccgcaaacgggtttgaatggcgctttgtctgagtaagcccctgtcgctccggctcaggcacgccatgggcccttatttttgggtcgctcaaggattttcgcccggcacatctcctcgtgaagagcgtcgtttttagcttgcgaggcagggcataaaacattcattccatcgcctgtgataacttgttaggggtgccatcatcatggttagacgcattggggtggaaacctccatcgttaaacacgcagacaaaaatgttgaagtcaccttgttgcaggtaaaggaggcgacgcgatgtatcctgtttgtcgccgggctggggggaagcccactgcgccaccttgagcttctgcagacctttacccggcagggtatttccgttgtcgcgccgcattttgaacgcctgacctctccctttccctccagggctgaattgctggaacgtagccaaaggctcgccttagccgggaacaacttttgcaaccactatgcctcgataaccggggttgggcattcacttggcacggtgattttattgatgcacgccggggccacagcctggaccaaagcaagagagtcggtcgtttttgacggcaggcagatgttaaatcaactagtgcttttagcaccgccagcagatttttttcgcgcgccgtcgtcgctggcatccgtcaacctccctgttcagatttgggcgggtgaaaaggacagcgttacgccactttcagaggccctctttctcaacgcggcattagcgcatcacacgcagacagatcttcatgttgtgaaagatgccggtcattttacctttatgaatacattgcctccgcacgtcaccgattcctttgcctcgcgagatacttttcttttagatttgggcgcaaagatatcccattttgttactgcttagtgccacagggcacagcctaacagcggccgggttaagaggggcgctaacgagataaacgcgttcaccctctgactatcaataacgcgatgattttacccatgaccagaagccagggcagggataaacgtcattgaatgaaatagcgccctgttgtaacccgtattttaattcgcggtgcgcggtagtaaaaataatggggtcaataatgaataaaaacggaggcgtgcttagcatgatagcgaattatgagtatctgactggaggaggaaatatcgttatcactgacatgacattaccataggtgctgaaatcaatgcttaaaaatgaatcatttacggtttcgcttatcctctctgtaacgtccgatcacataatattgaagtgaaataagctgctgtttaataagtataattaaatttttattcatttatttcccctggctgcctgcaatttccgtcatataagttacgctttgaaaggtgattaaaagcaaacaagacggcgaatggtatttataattacctgattgactggcactaccatcattttaagtggcaacgttattgtttgtaataaaccaggccggaatagtctgaaaatgcctttttttcacgggcataaacttctttgtcgataattaatttttgttttggttgaaatgcatttttaagaaaaaccgcattatctccgcagtaactttattatccgccaaaggccgaatgaataagccagataacgctgattctgtattgccatgtcctgtgaataaggaaacgctaacgcagaatcatcaatgacccgagaggaaagagtatgaaagcagtcgtttataacggaccctttgatgtttcagttaaagatgtgcccgatgccaaaattgtccgccccaccgatgttctggttcgcatcaccaccaccaatatctgcggctcggatcttcacatgtatgaaggacgcaccagcttcgagcagggccgtattttagggcatgaaaatttgggccaggtggttgaaattggcagtggcgtagagcgaatcagcgtaggtgactatgtctgcctgccgttcaacgtaggctgtggattctgcgaaaactgtgaaaaaggcctgacgggatactgtctgacagccaaccctggtactgctggcgctgcctatggctttgccgaaatgggcagttgggaaggcggtcaggccgagttgcttcgcgtcccctttgccgattttaactgcctggtattaccgcctgatgcggttgagaaggaagatgactacgtcatgctgtccgacatttttccgaccggctggcacgccacagagcttgcgggcttaaaagctggtgaaagtgtggctatttacggtgccggcccggtgggactcatggcagcgcattcggccattatcaaaggcgcatcggaggtctatgttgtcgatacgcatgccgacaggctggcactggcggaaaaaatcggtgcgattgccattaatgccacgggggctgatgcggtaaataagattctcgatctcaccgatggtcgcggcaccgattgcggttgtgaatgtgtgggctatcagtgctgcaacaaacatggtgttgaagacaattctgacacgatgaacagcctggttgcctcaacaaaagccacgggcggtattggggtggtgggcgtgtttgttccacaggacccgggtgcagcgactgatctggcgaaagagggcaaaatgccttttgactttggtagtttctggttcaaaggacaatccatccgtaccggtcaggcgaatgttaaagcttataaccgccagcttgcacgactgatttcgcaggataaagcgaatccagggcagattatctcgcatcgcttaaaactgtctgaagcggcagaaggctataagcactttgacgatcgcgacagcggttggacaaaagtgattttaaaaccttaagtcgttcgtcattaccatgattgccccagtctggtgagtacgcccgagtgcgtgtgaaccagactgcgggcgttcagcctctaaatgaaagcctttctttatcagtcaatcagacctgttggcattgaaagccttagctgaaggtaagccccatccatgagcatgatgcgcggatcgcttccagggcgaaaagcgtgagattcttctaaccgacaaggtgactgaaagggcgattaccagggcgcgcggtttcgatcaaaaaagaaacccgcagtcatcgcctggggagcctgatcggcaagccagacaatgccatcggccgcttcctcaaccgttctgtagcctgtatgcccattaaaatcggtggcggtgtagcctgggtcgacggcgtttacgctaatgccaaacgcagtaagttcatgagcaaatgccacggtcacgccattcatcgccgttttcgaactggtataacccattgcctggacgcgtgaatagggatgtgcccgatcggcgacccacgccagcgatcccagcccgctactcaccataatcactctggcttggggcgcgagtttaagtaacggaataaaacactgggtcacgctgatggcaccaaaaacgttagtgttatacaccgccataatatcgctgactggctgctcgctgggggcgacaggttgaatcccggcaatgccagcattgttgataagaatatccagctttccatctgacttcagtacctgctcagccgctgcctgaacgctggcggcctgagtcacatccatcaccgtcagatgcacatccagcccttctgcggtgagggtgttcagcgctgcgtggccaggctgctcgtcacgacaagccaaccagaccttataacccagtaagcccagttgcctggccgtctcaaatccaatgcttttgttcgcgccggtgataagaacacttttgttggtcattttctgctgcctcagttatctctgctggtgatatggccccgctaaacgcattaccgggcgtgttcagcatttatagcccaggcaatgctgtttgataacagaggctaatacgaataacctgatcgaaatggcgaacaatcttaggccgtgtagatgaacgatttatcgatttttctggcagtgtttaatgctaagggctttcgtgcggcagccaaaaagctggggctgtctccttctaccgtcagtgaaagggtgaccgcgcttgagctgagccttggcgtgccgctttttatccgcacgacgcgcagcgtaacgccgactgaagccggccggatgttgtccgaacgtatgtcgccactcctcagcgaaatgcggagcatactgaacgacgttgccagctctcagcaggcggtgcgcggggtgcttaaactgaacgtcacgggtgccgtcatggtggatatccttcccgcgctgatcgatcggtttcttgctcatcatccgcgcttacaggtggaaatcatggtcgatgatcgcctcatcgaagccacatcggaaggctgcgatgcgggaatacgttatggcgagcaccttgcccaggatgccattgccattcccatcggccctcgtcaacagcgtttagcgctggcggcgtcaccggcttatctcgccgctcacggctcgccgtcacatcccgccaggttaacggaacttgactgcattcgcctgcgatattccagtggcgcgctgatcccatgggagtttgcgcataacggagaaactgtccgcgtcgatgcgcccggacgtctgactatcggggtcaatggtgtgtcgggggcgatcgatctggcaataaaaggccagggcattatcgcgacgtttgaaaactggcttcagcctcactttgaaacaggcgtactccatccgttactcgaagcatggtggcctgcttttgaggggccgtggctctattttcccagccggtttatgtctgcgccgttgcgcgcatttgttgattttcttaaagaggagcgcgagggatgtgcggatgaaggcaggtgctaacgattcatgtcgtgatgcgatgcagcaagtgcgccgggccatgctcgcgaacaggctaaggcgcaggcagatttagcgttttaagggcgatgtcttgagcgaccagctgggttaatacaaaaccgtacggtcggggttaacaggggaagcgcagtaaattttaagactgcgtcagggtgcgctctggctgtcgcagtccgattgcttgctgcacctcacaaagcggtgacaaaatgaggccgccacagaggggatgagaccgtttttctgcgcgatatccaggtcaccgctattgtcacatgtcgcacctgccgaaacgccctggcagcggtgatgttcagaagccgtcatcgcaagctgtaaatcggtattcagatgagatttgtaatcatcaagcgcatcacgaatatcagccggagcgagccattccaggtgcttagacgggcactgccgggtgagttcagccatgtaagtttgccaggcatcgtcggcaggtgctgctgccagggctgcggttgaacctgcaaatagcaggacagccagttcaagtcgcatgatcatttcccacaccgttcagaggttatacatcgggatagccattttccatgctgcatcagtaatacgttgaggtaaagcgtctctgtcggcacaggcgcgagcggtgaaggcgcgccgttagccttgtttccagcttgtctggccggtcgcaatctcggttagcggctcctcgcgccactgccagggttgccgaagtaccacgcggctggcgaattttgctatgccaatctcatcttccagcaaacgctccatcaggtcctgaaacttgtataaattgggggcgataattttcaacagatagtcgtagccaccgctgatgttatagcactccacgatctcccggtactgacaggcgccggattcaaatttaataaaatcggcagggtaatgactgttgagtgtgatctcggaaaataccaccagattgttgcccagtttgttcagcgtgaccctggcggcgtaacccgaaataatgccgctttgttccaggcgtcgggtacgcgctaaacagggactggggctgaggctaatcgcctcagccagttcaactattgaacaacgcccctcgcgctgaagatgctcaagtattctgatatcagtacgatcgagaggcttaggatgtgacatagacaggtgattacctcggaatgggctgtgacgccctggctgcagtcgcttccgttaacgactgatcgagtacctcgattatcatttgcgcctgttccgccgtcaacaccaggggcggacgaatcttcagcacgttatgtcccattgcgcatgcactcagcaggacacctttctggcgcattctgttcaccacctgactggttagccagcggtccggggtacgggaagggcgatcggaaaccagttccacgccaacaaagaggcccgcgccacgcacatcgccgatggcttcatgcttgtgactgagggcggtaatgccctcaagcagaagcgcgcctaccttgcgggcatgggcaatcagatcatcctgttcaatggttttcagaacggccagcgcggcggcacaggagaccgtattgcccgcaaacgtattgaaataacgggcgcgttgaccgaactctgccagaacgtcagccgtggccagcagcccggcaatcggttgaccgttgcccatcggtttgcccagcgtaacgatgtccgggatgacgttgtgacgctgaaagccccacatgttttcgcccgtgcgtccgaagccaggctgcacctcgtcggcaataaacaatcctccggcctgtttgatggcatcgaccgcgcctttcaggaaacccgctgtgccaggcaggatgccatcgctggtaaacagcgaatcgacgatcagcgcggcgggcttaatgccgtggcgctgcagatcggcaatggcgttttcgacatcacgcgtgaagcgctcgccgagatcggccccctcggcatggtagagacggggcgcgggcaccaggcgcacatgaggcccaaggtcaaccgaggtacccagcgaaggcgagaactgagaaaccgcgtccgtgatgccatggtaagcagtttcggtcacgatgatgccggtgccgccggtccgtattttggcaatacggtaggccagatcgttggcttcactgcctgtgcaggtcagcatcagatgcgcaagcgccgtttccggcacggttgccagcagacgttcggccagttccagaatggtgtcgtgcaggtagcgggtattcgtcgcgagggttttaacctgctgacaaatggcctcggtgacggcaggatgacaatgcccaagtgaggtcacattgttataaatgtccaggtagcgacggccttcaggatcgataagccacacgccttcaccgcgcacgatgtgtaagggatgctcgtacatcagacgataagccggacccaacagcgcatcgcgcctttcgatcatcgcggccgtttccggtcccacgtcggcctgaccggggatataggcgtttaccatattaagatcggtggtgcttttcattaatttctcccgtttcagagttcagtcagcaatcggtcacgtgccgcatcgcgagacagatccgccatgaaggacagcgcctcccaggcggctggattatgacgcatgatataggcgcggttatggggatagcggaccgcgcgccattcggtaatcaggacggtaatcagatgacgggtggccatcagatcggtaacgatgtcttgctccatgtcgttgagcgggagcgttttgtgataggcacccacgaactgggctgcgccttcaaacggatcgggctggcctgacatttgaaaggccgcagcggtcgcgacttcgcccaccagtggggcataaagcatgtcgccaaaatcgataatcccggtaatgcggtcctgctcctctggcgccaccatcacgttgtagaggtgaaaatcgttatggatgacctgcgccctgattgccgacaggcgcggcaggacgtgcgtggtgaaacgcgtcataaatttctccgccagcctgcggcgcgtggggtcgacgagttcttccagcttatccatcagacgatgtgcggcagaaacgttccacagtagatcgtggctggcggcaggatgtgtgaaaccctgtaaagccagatcgagctgggcgaggcaggtgcccatggaacgacgttgtgcaggcgttcggtccgtgtccttaacctgcatcccgtccagataggtcagcatcctgacagtggtttttgcgccatcagcaagagtgacgttgtcacaatcttgtcctttgcgcgtccgcacaacacgcggaatcagcaggtcgggtgcaacctcagcgacatggttgagcgccttaatctggaaatccacaatcgacagcgcttcagagggattactgatcttcaacacatagcgcgtgccgtctgcctgctcgatgcaacagttctgatcgcgctcactggccagtgaccgaatgttgccctcaatgccatacatttcagacactaaagattgaatggccggaagtgagagggccggcgcggctgtgctcaatgcgacagcagggttggtgtgttcatcaagcatcattttccctcgctttaccgtctttggagacaaatcaaaggcccaacaggccggcaagctggcggaagttggtgagccgttcaacgccatagccgtcgacggcgggctcatgcccacgatcgataaatgctttgcccataaagccgaggtcagatgccgtcatcaggtcataacggaagctggaggagcagtgcatgatgtgttctggcccgcagcccagttggtcaaacatgtattcaaaaatctgcgcacgcggcttataggcacgcgcctcttctgccgtatagacagcatgaaagggcgctttaagatgggcgacgctgtgtgggataagatcggtcatcgaattcgacaggatcactaaaggaaaatgttgggatatcagttccagcgtttccacaacgtgaggatgcggctgccaggtgggcacggcgtcatagagggcctgcgcgtcagtatcgcggtaatccacatcatgagctttacaggcccgctgaatggcgttttccaccacctggaaaaagggcttccagtcgcccagcacttcatcaagacgatagaaacgaaagctttcaagaaaggcgggcatccgctgttctgcgatgcgatcggcaaaaagtgtttttgctgtcggtcccatttcaaaattaattagcgttccatagcaatcgaagctgataaattttggtttataaatcatgtgattaacccctttcatttgtataaaagaagtatatcgtggtgagcgaacagataatttcttattgaccactgaatggagtggtttttgctcaattcgccatagcacgcggcattatccgcatagcgttaatcatgccccgatggcttcgtcagcgtcgttccccggggccgcccaccggcagcgcagaaatttatcagcccgacttagcccaaaggcgtagtttgcgcctgcattgtgttttacactgcgcgctgaaaaaattgagtagattaacgattaggtaggcggtaatggcgatgaatggaacaatcacaacctggtttcaggataaaggctttggctttataaaagatgaaaacggcgataaccgctattttcacgtgattaaggtcgccaaccctgatctgattaagaaagatgcgtcggtcacgtttgagcccaccacgaacaataaagggctgtcggcgtatgcggtgaaagtcctgccggaaagcaaatacatcttcattgcgggcgagcggcttaagcttaccgccattaagtcttttgtggtttacagcgaagaagtccctgccagtagccgcattgataaagaaaatacagtgctgtctgtgggcattctgatgaacaatatcaaacccaaatcagccgaccaggccgatgagatgcgtacgctgaagaaactggcgatcaccacttttcagggggcgaccttaatcttctctgaggatgagattgatatcgatgccacggtgaaactgctcaaggtctgacagcttcgggccagaactgccagcgcctttctcaacaaggcactggcagcctgtaagcattccggtgcaccccatcgctgggtctctttggtccttttggccgctttcgaacaggatagttgtgttcgccaatgcttctggtgcctgtcttttacaccttacagactccttaataagttctctctgtaaccgaatatcagattaccttggtgaatgaatggctctcattcaccgagggtttcgtttttctgttccgttacccttcgtctgcaatccagcggttatgggtcagcattaaggttctggcatgtatgaatgtcaggccagggctgtcttctggaatgcgcttttcgttgttttgtaatacagcgcgcgccgtgctttttactgcactggcttatgctgtgatcgtagttgacgatgtgactgtcaggcgtgtaattgtgttttcagtacataattaatttatttttatcaaaattaaaaaaattggttttttaactgtaatttaatacgtcagcatttccattgctttgttttctgttgaggcttttcctgccaggtaaagaagattttaaaaaaacgctcgcatcagtcaggtttacaacatttttaataaagatgttatttgcatttatttttggtgaataaatttttttgtttgtttttatggttgtttaaagttgacagaaattaatgttaaaattggaattaaaaattcaattaaattataacattagcgcaataatctattgatttgatatctggttgaagattgtcctattattgtccgcaggacacggaggtgtcccggctgcttacagcgatacaaggataatgtaatggataaagatttccagaataacgcgtcagaagcacgtacccatctaaaaaatatctgcataaagccggagccggtaagcaataaatcccctccctgaggtgcccggtgagggatgattgccgtaacggccagggcgtcgggcgcctggtcatatgcaaaaactcatcgttaataaaactaacctcaacgccggtgttttcgaatattaccgaaaactcatctgactgttaaaaatacgtgtgcaggtaaaggcggtgaaaacaaaatcagtctcacgttgtgaatacgaaaggtttttctgagcaagcttcaagacagataccggagttgtcggcctttctttttggctgagaaccttttcgaacgttgagcaaaaaactgtctgcctgaccccgcgcgctgtgagttccccataacgggaaacagcgaagggcggtagcgtgcccggaatccttcggaagagcaaaaaatggaaaacccagccagtctgttacaccgtttgaatgcttattgtgcccatgccagggaagccgctgtctgcctgtgccaaatccgcgtgcgcagaaatgctgcctaagcactggcggctgaaactgctggagcagggtaaaggcatctgatgttactggcgcgccgcaacgaatgggatagggatgtcctcagacaggatttgtgcggcgggcacggcaaacaaaaacctcaacaccgtctgtagctttcgaaaagtattcatttaagtggtgcaggaagcagggttattagcttctctggcgggtaacagcctgttgactcagcaaatactgcctgaaatgagtcaggtggctgactgatatagcggaaaaacagatgctgacctcgctgacgctggaatgatgcgaggaagacgctgtctcgttggaaattgaccggacacaaggagtggacatatgagcaacaatccccccataagattcagtcacaaccaccaccggctttcggtgaagggatgtggcgcagagcttgatgtgctggcttttgaaggcgatgaagccttaagcagaccgttccgctaccggattgaattcacctgtacagaccatgccatcagcaaagagatgatgctgatgaagcccggttccctgacgctgcaggccccggctgacacgggtttcggtagtaaagtgcagcagacgttacgggtgattcagggcgtggtgaccggctttgagcgcctcagcgcttctaaagaggaaacccgctatgccctgacgctccggccgcgtctggcgttgcttgaccgttcgcaccagaacgccatctaccaggacatgtcggtgccgcagattgtggaaaaaatcctgcgcgggcgccacaacatgcgcggtcaggattttctgttctcgctgtcaaaagagtacccgcgccgtgagcaggtgatgcagtacggtgaggacgacctgcactttattacccgcctgctgggtgaggtcggtatctggttccgcttcaccaccgacacgcgcctgaacatcgacgtggtggagttctgcgacggtcagcagggctatgagaaaggcctgacgctgccgtcggtgccgccttcagggcagcattcgcagggcgtggattcggtgtgggggatggagagtcatcacagcgtggtgcagaagcaggtcagcacccggggactacaactaccgtcaggccacggaagacatgaacgctctggtggacgtgacccgcggggatgcgaccacctacggggaagcgtaccactatgctgacaattatctgatgccgggcagcgcgtatgagcgtaatccggtgcccgagtccggtgcattttatgcccgcatccggcatgagcgctacctgaacggccagacgcagacccgggccatcaccagctgcccgaccctctctccggggcaggtgctgaaagtcaccggcggttatgaagtggcggaggtgtttgcgcagggcgtggtcatcacggcgatgcacagccaggcgcggcgggatgaagactttcgcgtgcattttgagggcatcccggacagcacggatttttgcttccgcccggagccgggctcacgcccggtgatggccggcaccgtaccggcgcgcgtcaccagcaccaccgaaaacgacacctatggccacatcgataaagacggccgctaccgggtgaacatgctgttcgaccgcgataactgggaaaccgggttcgagagcctgtgggtacgccagtcccgcccgtatgccggggatacttacggcctgcacctgccgctgctggcgggcacggaggtggcgattggctttgaggacggcaacccggaccggccgtacatcgcgggcgtgctgcacgactcggcccacggtgaccacgtgaccatccgcaactacaaacgtaacgtgctgcgcaccccggcgaacaacaaaatccgcctcgatgacgagcgcggtaaagagcacatcaagatttccaccgaatacggcggcaagagccagctgaatctcggacatttagtggatgctgagaagcagaagcgcggtgagggttttgagctgcggacggataagtggggagccatccgggcacacaaagggatgttcatcagcgctgatggccagacgaaagcacagggccaggtgctggagatgcagccggccatcagtctgttgaaaggagcgttaaatcaggtaaccaaatggggaacgattactcagacacaccacaacgttgcccctgatactgagccattaagcgaatttgtttccggtgccagtgagcttacagagcctactttgttgctgtctgcaccgaaaggtattgccgccgtcacgccggaaacgagtctgatgtatagcgggaaggggctatatctacagagtctgggcgaagtcaatgtcagcacagcacagcgctattccgtgaacgcgagctactctgtctcaatccttgcccagcttgaagggatgcggctggtatccgctaaaggtccgcttaatattgagtcacatggagatgtcctgtcgctgacttctcttaatgatgtcactgttcagtcaacacaagggcacctgcagttaacggctaaaaatggcatcactctgggctgcggtggggcttacattcgtcttacgccacagggggaagtgcacattcacggtccgggattaatcagtctcaaaggcctccacgatttgcaggggccagacagcgagaatttccccctgcctgaactcccggcatcgatatgtaaagagtgccttaaaaaagcccgggagctggcgcagggcttcgtccccagggaggcataaatgaccacacaatggattgaggaagtcgctgttacttgccggacatccgggactgattatcttgatattattgttgatcaggctgggctggatttcagcgtgataccggcactggacgcactctctgtggagtggcagtcgctttatcatgggcttccggaagcgtttattgtcgatgatgcgccgctgattgcacgcattacgctcgatgatcctcaacagatgcagtggctgaaggacatgagtcagttggtcgctgttcagtctcctttgctgctcttgtgttcacactggcctttttctgccctgactggctggctcacacagtgtatggatattctgcaggaaggacggagcggaattttacgattttacgatacgcggattttcccactgctttttacgcacgttctcaaagaggaacagcaacagcctttgttgcgtcctgtcctgttctgggcctggcaggatatggatggcaactcaagaggtataaaaggtaacagtacgcctcagaatcgcaatgaaaaacctcccaaaatcgacctcagcgatcgccagttggatcacctgatgtgtgtctgcgatgtcatgatcctcctgtcccacagtgcaccactagcggccaggtatacatcacaacaagcgcttttttttgattgttatcagggcatggtggaggcaaccaaccggggcattattctggatgaagcccgcgaggcctgggtcattgaaaaatggcttacttaaaaagtaaagatctaatagtgaaaggaaaccgcttcagcccgggtgccgccaccgctacctcttcagttttgcctcttcagggaacgtcagatgaaacatacattcttaaccccgctgctggcgggcctgctgctgttaaccggctgctcacagcctgccgctcaggccggaggtggcggcggcaccattgacgccatcaaccacaccagatgggcgattaaccacttcagtgtcgataaccagtcgggcatcgacattattggcccgttccagggaggtggcggaggctgctgctacagcgtgcccgcccgctggacgccgggcatgacggtgcgtgttgactgggaaagtggtgtggggtactccatggattttcctggctatgaagacaggaaaaaatatctcgcctggaaaaaaaatattgatgctcaaaaacggcagcacagcaaaaccgtcccgttacccgactataacggccaggacgtctgcggtatcacggtgcattttttaccctgcgatgacgtgaaggtcacgacgagttgttacacctacggcagtccgtcctacccgataaaagagcccctcaggatgaaggagccggaagtatgtccgaaataacggaaaccgcgtcagcccgggtgccgctgccgtttcccctttagtcccgcctctgcaaggaacctcagatgaaacacacactattaaccccgctgctggcgggcctgctgctgttaaccggctgctcacagcctgctgctcaggccggaggtggcggcggcaccattaaagccatcaaccacactaaatgggcgattaaccacttcagtgtcgataaccagtcgggcatcgacattatcggcccgttccagggcggcgggggtggctgctgctacagcgtgcccgcccgctggacacagggcatgacggtgcgtattgactgggaaaccggggttggtggttctaaaggttttccaggattcgctgacagagctaaatacaaagcctggaagacaaaggttgacgaacaaaaacggcagcacagcaaaaccgtcccggtacccgactataacggccaggacgtctgcggcatcacggtgcactttctgccctgcgatgacgtgaaggtcacgacgagttgttacacctacggcagtccgtcctacccgataaaagagcccctcaggatgaaggagcccaaagtatgtccgaaataacggaaaccgcttcagcccgggtgcagccgccatttcccctttagtcccgcctctgtaaggaacctcagatgaaacacacactattaaccccgttgctggcgggcctgctgctgttaaccggctgctcacagcctgccgctcaggccggtggcagtggaggtggtggcggcaccattgacgccatcaaccacaccagatgggcgattaaccacttcagtgtcgataaccagtcgggcatcgacattatcggtccgttccagggcggcggtggcggctgctgctacagcgtgcccgcccgctggacgccgggcatgacggtgcgtgttgactgggaaaccggggagggggggtcaaaaggttttcccgggtttgcagatactgaaaaatatctggactgggaaaaaaaaatgaaagcccaaaaacgtcagcacagcaaaaccgtcccggttcccgactataacggccaggacgtctgcggtatcacggtgcactttttgccctgcgatgacgtgaaggtcacgacgagttgttacacctacggcagtccgtcctacccgataaaagagcccctcaggatgaaggagcccaaagtatgtccgaaataaaggaaaccgctccagcccgggtgccgccactgctacctcttcagttttgcctcttcagggaacctcagatgaaacacacagtattaaccccactgctggcggctctgctgctgttaaccggctgctcacagcctgccgctcaggccggtggcagtggaggtggtggcggaaccattaaagccatcaaccacaccaaatgggcgattaaccacttcagtgtcgataaccagtcgggcatcgacattatcggtccgttccagggcggcggtggcggctgctgctatagtgtgcccgcccgctggacgccgggcatgacggtgcgtattgactgggaaaccggggagggggggtcaaaaggttttcccgggtttgcagatactgaaaaatatctggactgggaaaaaaaaatgaaagcccagaaccgtcagcacagcaaaaccgtcccggtacccgactataacggccagaacgtctgcggcatcacggtgcattttttgccctgcgatgacgtgaaggtgacgaccagttgctggtcaccgagaaatgccaattacccgataaaagagcccctcaggatgaaggagcccaaagtatgtccgaaataacggaaaccgatttagcctgggttccaccgccgtttccggcccagggacgcctgccgacgcaggcactgcaagttggtcagaattgccatcagcagaacagcgccgagcggctctaccgccaggaactgtgtctggcggccgggcgacgtgtcgagccgccatgctgcaagacgctgcatatcagtctgtttttcgacggtacggggaataacctgaacaatgacctgctgctgtctgacccgaagcatccgaccaatatcgcgcggttgtttcgcgccactatcggagatggtacagcaggtggcgtatctgatacgagcaggatgccgctggattcggcaagcgacagcggcggcaaatacttcaaattttatattcccggtgtgggcactccgttcccggaagtgaacgacccggactactccaccatgggactggtgggcgcaaccaagggtgaagagcgcattaactgggcgctgttgcgcattattgatgtactgaaatttaccgcaactgaagagtggctgagcaccgcagagagtcgacagtccatcagcaaaatgggcaccagctggaaccgtctgtggtctggcggcagccataaccgttatgaagagttcagtcgtttactgaatgagttagccccgcaactgaaaccactgctcacgcagccggagccgggcaaaccgaagctgctgggtatcaaactgtacgtttacggtttttcccgcggtgccgccgctgcgcgtacgtttgtacgctggctgagcgagctgcttcccccacccaaggctgagggcgaaaatcccccacagtgcctgcagattggtgagatgcagttgcctgtcagcgtggagtttctcgggctgctggataccgtggcctccgttgggatagcgcacgttgtgccggttgcagaggggcatatgtcctgggctgacgacacgatggagctgccggacgataaaacctatggcggtttgataaaaaaatgcgtgcatctggtgtccgggcatgagcagcgcctctgctttccgctggactcggtgcgccggagtgacggcaagtatccttcctgtgccactgaggtggtttacccggggatgcactcggatattggtggtgggtatccgccaggagatcaggggaaggctaatgctgaacacgatggattgtttctatctcagattattttgcaggatctatactcctctgctttcgggattggagcacccctaaaagtaccgcaggatgtattaccagaatcatctacagataattggcgaatcatgcctattgatcttatttctcaatttttagtttctgatgtacttgtcaatcgcttcaacgcctggcgcgaactcaccctgaacctgaccacaccagaaaaaatcacgcctgaagaggcctcccaatacgaaccaccgcgcgccagcggcagtctggaaaccgtcgttgaaaaccagattgcgtggatcaccgcctggcgtatcgagcgctatgccagaggttcgatgctgaaaacacctttctaccagcgcgccaccaataccgaagcgctgcccgccgcgcgcaaggcggcagaagaagcacgggatgaaaagcagcgaaaggtgcttgaaaagcgtcaggatcagttagcaaaacagtctgccgacaggatggatgagcttgtgctctatccgggcatcaaggattttgacccggatatggcgcagacccagttgtttgaagcggcgaaggagtttggtaaggattaccacgacggttaccgtatcccggagaacctggcgcaggcggtgctggataccgtgctccagccgatgattttcgtgctcaataccgatgatgaaccccgggaataccggcgaatgaaggctgacggagacgcgcgggtgtcagtcctgtttcctgccgccggtgaggccagtaatgccggacagccagccgggctggtcagggccttattcgacgatcaggtgcacgactcgcgtgcctggtttatgcacgctgcgctgggttctcgcgagatgtggggcggctacttccgctaccggatgatttatttcagcgacaaatgtaataagtccctgtcaccgctggtgatcgccggggatcttatcggatttgccaccctgaccacaggagttgtgctgagcttcagacaaaagaccctgaccggaaagctggcagggctggccgcgacaggcgccgtacgaacgctgcaggttgaagtgctggatcagatcaccggtgaacccgtgccggaactgccgggcggggaacagcagcgggcatttacccgggagccgggcgtagtggttgcacagcgaaaagcgcttgtggctgaacaacagctggcgcgggcgcaggctgcgatcccggccagctggcttgagcaggtactgacggcaactgcctgagacagaataaggaaaggagaactgatgagtaaagtcatccggaaaggagacagcctgagggaatatggtggcaaggtattaggcgggcattaccagtgttttggtaaggggtttgcctgtaagggggacccggttcgctgtaacaaacacggtgtgaccaccattgctgaaggtagcgcattgaccacggttgatggacagccggtagcgctgcatggccaccgctgtacctgcggctgtacgctggtcagctcatttcctgactgcggtattgaacaatgaggcccgaacctgattatccggcgtacaaaacggcacgtccgcccggtgcagccaggtggctgtcggccatggcactgctggtgctgttctgcggcggcgccggggcgctattgccatcagcccaaggcaaaagttcgcttgttgccaccagtatacttgtggcactgctgctggcgggcacaggctggcttgtgcggttgttgtactatcgtgtcagcatgcataacgctgctctctactatcagttggtggaatatgaacagcagcagtggtgggcgcagcatcgtcagccgttctggttaaaagaagtcgtattgctggggccagcgggtacgcgcccaattgactggctgcgtgtacttaatcgtgaacaacgcccaccggaggaaaaaaaagaggagggcggcagtgcattgagattgccacaaatttcggccacagatgctgtcacgcgcgaaaaacggcttgcggaactgctggttattgcgtggcaaaagcagcgaactgaacaaaaactctctcctccgctgcgttgttactggcagggtactgatatcacctggcaggcatttcgcgaaaagatgtcgatggctttcccggaaatcgcgctgccagcgcggcctgaaccctggcatggggaagccactcttgcagagatagcgagagatcttgctgaagccaaacccgaggacacgatacttatagccgggtgtcaggtgatcgcggcgcagcaaggtatagcgcgtcccgccggagaatctgccgtactgtggctggccggacgtaatggcccggtacagttgacgcgtggtgaaactttttcgccggagcaaggtgatgttttgctcacagttctcgcccgttcactggaacaaagtgaactgaaagatcctccagaagcctgtacgttgttttccctgcccggcaccgaggcgctggcgagcagtggctgggatgtcagccagcatttgcaggacgtcaactggggggatatcggcgatatggacgctttgatcgttttatcgctggcggcaatctatgcctcccaccaccaacagccgtgcggctggattgcccgcgacccgatgaataccctcgcaactggaattgtaaaacctgatggacaacaccaataaacctgctgccatctctgtggcagccacggcaacggtctgtattgctatgaccaccctactggtactgctgggtggactggcatggtggctatgggcgaccgaacgttcaacggaatgggaaatgctgcgcccgcttattgtttctggctttatcgtctggggcattgcgctcagcctactggtactggggtttatggctttacggttactggttaaggacaaggttcgcccgccagcatcctgcaagcgtaaacccgcaaaagttaccggtggcggaagggcttatggacagctgaagacatatcttcgtacacgctataacctcttctggcgccataaagtccgcctgctgttaatcaccggcgacgaagccgcaatcgaacagctggttcccggcctgcagcagcagcagtggctggaaggcaaccgtaccgtgctgatctacggcggcagcctcaccgctgaacccgataaggaaaaatacaccgcgctgcgcaggctgcgtcgcgggcgcccgctggacgggattgtccgcgtcatgcctgcgtcgcttaacctgacgccacacatcagcgacaacgaccttcgcgcgctggagaaaatcagcgaacggctgcgctactccgctccggtctggctgtggcagttgtgcagcagcgactggccgcaggccacgcgccctgagcaggcggtcggggcaacgttcccattgcgcgccagcgaagatgatatcgtccgccagcttgagcggatgctgccggccctgcgggtgcaggggataagccaggtcgcggagaacaacagccacgacttcctgctgcgcctgggccggcacctcagagagggcggtatcgcccgccgggctcagcaactggtgccatggctggctgcctctcagcagcgcgtgccgctgcgcggcctgatgttcagcctgccgcgggatacccccgttgatgtgtccggggcagttaaatctcctgacgctgccatgacagaaaaataccgccctgaatcacaacgccatgccctgaccctgccggtgacctggcagggcattgtggacgactgtgcccgcgtacgcggccggcgtgtcgctgtgccgtgggaacaggcgaccggcgggacgctgatggccatcatgggtgcctggggagcggggctgctgctgtcgtttgccgtcaaccgccagcagattatctccgttgcgcagcaggcgcatgccctggtggagcatccttccgtatcggatgaccagctgacggccctgcacacgctgcgtaacgcggccggccgcctgcagcaccgcatccaggagggcgccccctggtatcagcgcttcggtctggaccacaacacgcagctgctcagcgcgatgctgccctggtacggcgtggcgaacaaccgcctgatacgcgacccggcaaacgccgccctgatgcagaagctcagcgcgctggtgaacgccgcccccgacagtgaccagcgggcagcgctggcgaagccgggctatgaccagctgaaagcctggctgatgatggcccgtccggataaagccgacggcgcgtcctacgcccggaccatgaaggccgtgcagccggcgcggcagggcatttcagccgccctgtggcagagcctgtcgccggacctgtgggccttccacatcagcggactgcctgaacagccacagtggaaaatcacgccggatgcgcagctggtcagccagagccgccaggtactgttacagcaaatcggacggcgtaacgccgaaagcaccctgtatgaaaacatgctcaaatccgtgcgtcgtcacttcgccgatgtctctctggaagacatgaccggcggtaccgatgcgcggcgactgttcaccaccggggaagtggtgccgggcatgttcacccgccaggcctgggaaggcggcattcagcaggctgtcgaaaatgccgcacgttcgcgccgggatgaaatcgactgggtgctgagcgacagccgcagtgccgtctccgcagacctgtcgccggaagccctgaaggcgcgtctgacgcagcgttacttcagcgactttgccggcagctggctgagcttcctcaacagcctgcactggaatccggccagcaacattgcggacgttaccgaccagctgacgctgatgagtgatgtccgtcagtcgccgctgattgccctgatgaataccctcgcctggcaggggcagaccggccagcaaagcgaaggcatcccggacgccctcatcaaatcggctaaagacctcgtaggcgggaaagacaaccccgcgactgacccgtccgcttccggcccacaggggccgctcggtgaaacctttggcccgctgcttcagcttctggggaaaaacaaaggcagccatgtgatgtcggctgacaattcactgagcctgcagacgtatctgacccgcatcacccgcgtgcgtctgcgcctgcagcaggtggccggtgcttctgacccgcaggcgatgatgcagaccctggcgcagaccgtattccggggcaaaagcgtcgacctcaccgacacccggcagtacggcagcctgatgtcggcaagcctgggcgaggcgtggagcggcttcggcaacacgatgtttgtgcagccgctgacccgggcctgggaaaccgtacttcagccgtcggcagccagcctgaatgacaagtggcgccgctccgtggtggcgaactggcacaccgccttcgacggacgtttcccgtttgtcgccagcaaaagtgacgcctctctgccgatgctggcggagtttgtgcgcagggacagcgggcgcattgagcgcttcctgaacacggaactcagtggcgtgctgcacaaagagggcagtcagtggataactgacagggtcaacagccaggggctgagcgttaacccggccttcctgcgggcgattaatcagctgagccagctgtcggacattctgttcaccgatggcagccagggcatcagctttgagctgcaggcgcgtcctgtgccgcaggtggtggaaactcagctgaccattgacggacaaaagctgcactactttaaccagatggccgactggcagcgctttcgctggccgggcgacacctacaggccggggacgatgctgacctggagcacggtcaatgccggagcgcgcctgttcggggactacagcggaacctgggggctgattcgctggctggagaaggggaaacgcgagcagcttgaccgaagccagtggatgatgagcttcagcgcgccggatggccgaaccctgcagtgggtgctgcgctcacaactcggaaaaggtccgctggcgctgctggaactgcgggggttcacgctgccggatcagatattcagtgtcgacagtgcggtgatggcgcagacggcagacgttgagagcagtgacgatgaagggaggggataacatgctcctgactggcgggtgctttacggataatcagggcagaacgcattcacaaagaaatcctgtatcaactgaggacgttacctgacgcaggccgataaaatgacatgtggcgggataaccacaacgggcgcagaagaccacagcctgtttgataaacccgttgccaggatagtgtgaactgcaggaacctcgctcgctatcacaacatcgccggtggcatcgacaacgacaaccttcacaccaggaaaatcgcagtaacccgctacacctcatgcaacgtacaactgactctccgatcttaagcgcgcaccacatcagcgtctgcaatctgacaccgcctcaggtataatcccgcccattccttatcagattcagagacgaagatggcaaaactcaccttacaagagcagctgttaaaagcaggattggtcaccagtaagaaaatggacaaggttcagagaacggccaaaaaatcgcgtgttcaggcccgcgaggcgcgcgaagctgtggaagaaaacaaaaaagcccagcttgaacgcgacaaacagctcaatgaacaacaccggcaggccgcgctttcaaaagaatataaggcgcaggtgaagcagctgatcgaaatgaataaaatcgacatttctaaaggcaatattggttttaacttcaccgataataatctgattaaaaagataatggtcgataagctgacccagtcacagcttattagtggccgtctggcgattgcgcgtttgcaggcagacaacagcgaagagagtcattacgccattatccccgcgagcgttgccgataaaattgcccaacgtgatgcgaacagtatcgtcttaaacagtgcgctgagtcaggaagcgcaggatgaagacgatccttatgctgatttcaaagtacccgatgatctgatgtggtaatgactgcaatcaggcgggataaccgctgagccttgcagcaaagtgctgtgcactctcgccgcagggctcgcgccgtttgccgctcggacggcggcggcagggcgcattaccctgggccaggttgaccgcgcatttatcggtattgagcatcgataacatcgttccggcatcctcaggcgagccgggatacataatcaagcctgatccgatcgctttcgggatcgaaacgccgcgactttcatgcgattgccacaggtcgccatgctgcaccagcggcggcggtgcgatttactgaggtcatggaaaagcaggatacagtcatgtgcttcacactggcgcacgtacgtaaagctgtcactgacaacaagctcgaccagtgcgttgaccacgggccaaagcagggtggctgtacttatctcctcgtggctaaccgcgatctggtatcgctgcgcgtcatcatcccacgccagtcgctccgtcgggcgcccgtccttatagagcctgttaagaacagtcaggtccgcagataagccattcatcgcagcatcgactaatgcacgtgcactatggcgcagcgcccgcgcttcatgtaacagcccatcaggtgcctgcaaaggcgcgccatccggccagatccctgccatctccagccagcgcatcacgcgtcgatcgtcgctgaaaccgtcatgtcgctgctcgtccacgccgtattcactattgataaagtccagtgcgaggttatccgccaggaaaaggaagtcgtgggtgttgagatcaggattcatagctgcctgtaactgttaaaaacatatttgacaggttagcaaataagatcgtaaccttcaaataacaactttaacggttacatcataaggaaacatcatggcggcttcaaaatccattacgacgacagacagtttgcgtacgcacgacgttaacgatgcacagcaactggatggcgtaaaataccgctacgagcaggtcggcgacgtcaaggtgttttatcgcgaagcgggcgatgccagcaggccaacaatactgttactgcatggctttgcggggtcatcatttatgttcagagacctgattccacaacaggccgggcgctatcacgtgatcgctcccgacctgcctgcattcgggtttaccgaagcgcccacgcgggacgcgtacgcttacaccttcgatcaactggcgatgactatcgaacagttaacacagcagctcaggctgaataactatgcactgatggtgcacgattacggcgcacctgtcggctggcggcttgccgtcagtcatccggagcggatcacggccattatttctcagaacggtaacgcctacgaggaagggctgggagagggctggaaaccgattcagcgctactggcaggaaccgactcaggagaaccgcaatgcgctgcaagacttcccaacgcccgcctccattaaatggcaatatcttgagggcgtgccggataaaagtcgtgtctcacccgatggttacacgcttgaagggctgcaaattctgcggccgggtaacgcggacattcaactcgatctgctgctggattacgcgtcaaatgttgctatgtatccggtgttccagaactacttccgccagtctcagccgccattgttagcagtgtggggaaagaacgatcccttcttcctgcctgctggcgcgcgtgcgtggaaacgggatctgcctgcggcggacattcgtttctttgataccggacacttcgcgctcgaaacgcacggccaggtgattgcgagcgtgatcgcagacttcctggacaacttacggctgaaataaaccgatatctggtgcgatgcgaagagccggtgccgcgcagtgcaaggcggccgggcgacagcggtgtgattaatgtgcgttaaaacgcgctggggcagcgagcgtgaaacggcttgccactgacgggatggacaaagtgcagttcactggcatgaagcatgagccgcggcgtctgctgcgtacccggcagatcaagaccgccatagagatcacagcccagaatcggataacccaacagctggcagtgaatacgtagctgatgcgtgcgtccggtttccgggctcagtatcacccgggtcaggggaagggccggggcgtcatcccgtttctgatataaacgttcagtaacctggtaaccagaccgggctggtttgccatggcgcgggcaaatcgacatccgtggaaagcgggccgcatctttggcaatcggggcatcaatcacaccttgctcatccgttacatgcccgcacagcagcgcactgtattgcttggtgacggcgcgcgcgctgaattgctggcaaagcgcggcgttaatggttttatttcgcgccacgaccatcagccccgaggtgccaaaatccagccggtgaaccagtgtgcagccaggaaacagttgcaccaggcgatgatgtaccgagtccaggttttgtgggtttttacccgacaggctcagtagtccactgggcttgtcgatcagcaccagatggtcatcctcatagagaatgcttatcgcctcgtggcacggcggagcaataaaagtatcaacgatcgtagacatcagtaagcctgaggagtgagcagggagggatgatagcgaattattaacggtcaggcgaatggggctgattgcagaacccgacagccacaggcttatatcaatgcgattaatgaggcccttgctgataaggcggcatcagcctgctggcgcaaactcacacatgatgctggcgagaatgcgacgaacaaggactgttgtgggtggcaacgggaggattaatctttagccgcgagccataatgtccggccattgcactgctgatcctcgacaacatgatgcacaatatggaaatcgtactgctgcaggagtgacgcgtattcaagcggcgacaggctggaatgataaagcggctcaccctgaaattcacctatggcttcgccgtccgccgggccagcgttaaacatcagtgcggtgcccttactggcatgcgcagaaaaaatggcaaacatctgtcgctgatcggcacgggtaagatgaaaaaaactgtcccaggcaagaataccatcgaaacgatgtcccaactgcagctcccgcatatccgccacttgccaggtgtgttcaggaaaggtttctttgcagcgggcaatcattgaaggcgagctgtcaatgcctgtcacacggaacccacggcttagcagatacccggcaatcggcgttccattgccacatcccagatccagaatatgtccgttgggacgaacatgatggaggaatctgtccagccagggtttttctgacaggttggtggcgcgcagttttgcaaatgcggcagcgtttctttcatacagtgatattactgacctgaacgcctcattatccatcatctctccataatctcagagttatcatcattatcactatcgtgatcaggttcgcggcgtaagtccggcagcgtcgaataacacgatccgttcccttacaccgcgaatgatttacgcccctgtttaaaaattataatccagcatcaacgtgtaacgggtagtgatcgcatcgccttgagtgacccaactgccactctgatttttcaatgcccccgtgacttcgccagaaacagtaaagcgcgtagtcagcggataattcatcgacactttcagaaaacgactgcgggtgttctggaatatttcaccatcctcaggttgggcattatttttcttataatgtccatatcccccgctgagggttgtagagagttttccccagttatgccagacgcctacggatgtggtccagcttttttcgtctatatcgccccattgttctctgtctaaaattcccgaggcgaattgctggcgaaaccagatgcccgttgtgttgttgataatatactgcacacccggctcaatctggaatgaacgcacatcacgatcattttgtgaaccgccactgcggcggtgatcgatttgctgataaagataattaaagaatgagaggcggtctgttaaacgtaaatcggtaaagaatttgacgcgcccctgccagcggtcctctacagacgaacttccacccatcacatcccagccgtagcgcagacgtttgtagaaatattcgtggccgacaataagttgagtccactgattctggctgaggtaagtctggtcttcccaggtaccgttataattggtggttcggccttcagaaaaggccagataccagccgggtaatgcatcatgacgcattacgccctgcacaaaggtgagtgagtcattgccgttatgaaaatggctgttacgccagttgttatcctcaatcgcatatttcatttttagctggccatgaacgcgaccgccggctgggtttgatgagcgggcagaggtccacatgatatcttcatccagataggaccacggatcgaccgcaataacggtgcctgataaatccttcatgacgctcatgctcgcatgggtcagggttggacacagcagggaaaaaataatactcagggcatgatgttttttcataatacgatcccattaaatcatttcttttattttcaacgtcgcgtgaaaatgatcgttttgaggcaggctgatgctccagggtttcccctccatggaatacatccgggtactgaatgccgccttattgttgatgtaaaaaacagcaattgagttttgtatcaggacgcgcaactcaattttttcatcaagcggaacatctacccaggattccgcattgtcctgatgaattgaggtcagcggagagttaaaaaaataaactttccctttgctcttattgaacaccacgttcagcccggccttattgatgctgtcgtcagtaaggccaaagctcataaccatgccggcagagggaatatccacggtggcagtcagcaccgcgcgtttaggcaggggcggatacacagaggactgtagcgatgcgaactgtgtggtcgtttttagcgttttactttctgtcagcgtggtaaccgggcctggattcgcgtcgatggcggtctgcaattcctgcggaataacactcttgagctggccctgaggctccgcgattaactcgtgaacaaccagattccctgcccagtcaatattgccgctgtcacggtttcctgctttggtgggtatccaaccaaaaacgaataagcggtcgtttttgcgtaccagttttcccgcgtaaaaacctgagccatcgaccacataattatccgtttttcgccacggcccttccggattatccgcgacacggtactgtgtcagacgcagcggccactgatcgctaaagctgagataccaacgcccgttgaagaacaccagcgtcggacattcgagattggcgttcgtggtgatagtgtcattatcgaaaaagataccgctgtcttcccagtttgttaaatcggttgaacggtaacgggcaataacccctcggccgttgctacgcgtggtaattaacatccagtattcttttttttcttcgatccagacaacgtgaggatcgcggaagtcattaccgcgatacttattgcccggcagaagggtgtcattgggatgtttaacccagtgaagacgatctttactggtggcgtgcataatggactccaccggaaacacgttttcattgtgggcggtataccaggcatgccaggtgtcgccgactttaatgatcgatccggttcccaacagcagttccgggtcgtcaacgttattgacgtagggaatcacttcagagtggttctgataatcatataagttggcactcgacagcagatgaatcgcgtgcacgcctaagtcactgccgccacggacatcattaagataaaaaatatcaaattcgccattgttatacacaggcatgggatcgccaataaatgagccttccactcgcgggaaaaagccattaattcgcgtaatgcttttattttgtaatgtttctttagagggttgtgaataaactggcgtatttccaacggaaagcgtcagcagtgcgacgaatgtcgctaacgttaattttttcatgctgcacctgaatatcagaagttataattcacgccaaccacggtaaagggattccatgagtgacctttatatgtccagagtccgtcttctttcgtaaattctgctctgaattcaccatagagtctgacttcaccaaacaccggatagctgagggtgccgccgataaatttatagcggccattataaaaaacttcgttggcgttactggcgttctcggttttgtcctgaccgaagcccacatacagcgaggttaaaagcggataccagtttcgccaaagcccggccgttactttccattccacttcaacaatgtcaccccagttttcacgtacctgacggttatagtaataataaggccgtaaatacaatcccatatccggattcacgcgatattgaatagccggctcagtttcaaaaatatattgttcaagatcgccatttcccggttcattgccctggggctgatattcgccataagcataaccggcaagactccatttattgctgagtcgcaggtcctgccagactttaaaacgattcttccagcgtttcgtggctgtttcggaaccgatcatggcttctgtacctatattacctcgccaggtttcaaagatatggccaacaaaaaactcattaatcgtattggtggcatcgtatttctgattactgaactggcctttatagctgtcttcccgggcattccagaaaccaaagtaccagtttggtaactcatcatgccttaaaaaagcctgtatggttgcgagcttaaactttccgctgtttttactcttatcacgccagcgaacatcatcaatttcgatctgtgtgccaatgttgccgtgtaagccgccagcctccatattgcggccgatactgttccagtgaaccggcggatcttcctgtcttaaacgcagtaggctgacatctgctggcatagccaccttactgctgagttcagggtcggttatgttattttcgcctgcaggggataaggtcgccggcacgggtgatgcggcatgttcggctgtcctgtccaccgtaaccggcgaggaggaaacgtggctgaccggcggcgcaggttcctttttagcaggcgccgtgcggatagggtgattatccgtttcatcataaaaataactttgatagttcccggtataaacatttgacgggtccggtgtgttttcggctgcagcaggaaaggccgctaatgacagcatcaatgccagtgtttcttttcccgaaaccctattttttctattcatcacactaacccggtggaacggcgttaatatttcatccatttttctgtctcattatttcaggcgagagcagccagtcagagactgacagaaataaaaaatcagcaactaagaggcgttacggatcgggacggaattatctgtccagagaccagtacccagcgtcttctaaggcagcgacgccgttatgggcaaacaacgttaaatcacgcttgtcaggctgagggtaaattcggctactcaggcaggcggtgccctcgttgacaaacacttccactgaggaacggtcaatgaaaatttgcagcgacagtcgcttgtctgctggcagggaaatgctgcgtgtgccctcaagcaaaaattccgggtaacgacgctcgacaattagccgttgggcctgattgtcgacgtaaattcgcagcccgtcgcctaacgcaagaccatattgctccgccgaggacgcgttgagatcccattccagccgcacttcaaccgcctcggcatgttccccgatagacagggtttgattgttcagctcgcgcaccgggaccgcataataacggccacgcagggcggcgacctcggccgcgggtttcatccgcacacggtcatcatcgcccaggcttaactcacgcggcagagaaagcatcccggcccaaccgtcctgctgttcgggcatcggtgattcccacatatccagccagccgatgacaatgcggcgaccatccggggtcaggaagctttgtggcgcataaaaatcgtgaccatggtccagctcaatgaattgtccatcatgggtgaaggcttcaccgggttgccattcgccgagcagatagccgctctgaaacagattgcgatggtgataacctgtcgctgcgatcccctgcggggagaacatcaggacgcgtcgattgcccagggaaaagaagtccgggcactcccacataaagcccattccgtctgccgcctcggcaaaaacaccttcgtcgtgccattcacgcagatcggcggagcgatacaggcgcacctggcctgtgtcctcgacgcgggagccgacaaccatgtaccagaactcaccttcgcgccataccttgggatcgcggaaatgatgcaggcctggcggggtatcgatcacgcaaccctggcgttcaaagtggataccgtcgtgactggttgccaggcactgaacctgatagaggttgtcatccgtgtcggcgggtccgtgaaatttatggcctgtataaatcaatgccagcgtgtcgccgtccaccacggcagagcctgagaagcagccgtctttgtctgccgggccttccggtgccagcgcaactggcagatgctcccagtgcaccagatcttgactgcgggcgtgcccccagtgcatcggtccccattttgtggagtaggggtgatgctggtagaacgcgtgataccagccttcaaaccagaccaggccgttagggtcgttcatccagcctgcgcgagcggcaaggtgataacgtggataccagcgtggattaatcccggattgcgaggtttcaagtgcctgttcagcctgttttaataaagatgtcattgtttttactctcaataaattacacagcgttttgctgtaacaaggatggctcagaggaggacttagttgagcgcaaaaggaaaatggaaataaacgtcgtgcagaacaccatgatgcccataatcagataggactgggcgaagccaaaccgctcatagctaaagcccgccagcggcgataacacggtgccaataattgagctggtacaggcgaagcccaccagatagatagtggaagacagacgcttatcgaaattcagactgttatatttaaaaatggcgaccaacaggatagggagttcaacagcgtgaagcagtttggtgatggaaatcagcagcggacctaccaccaggcctgatgccaccatgcgcagcgccatcaccataccggcgaatatcaaaccatttttagcgccaatccggttaaccagccagggcgcgcaaaacatgcctgctgcctccagaaagacctggacggagtttaaatagccaaacatggcgttcccttcttttaacgtcggaaactgagaagagaaataaaccgggaattgctgatcgtacacgccataaatacaggtgccgaccacgaaaaagatcagcgcccagaagtgcggcagggtaagcaggcgaaaggcatcggcaagcgagacttttttagccccgatttcgagtttctccatacttgccggggccgctactttcaaacgcgccagcaggcagaagaaaaccagtccggagcatgatgccaccaggaaattaagattggggttgatattaaacagcagcccggcaaaaaacgtggcgatagcccaaccaagggagccccacatcctggcccggccaaactcgaagctgctctgacgggcaacgcgttcggtataggattccagcacaccgataccgccgttaaaggtcaggccaataaacacaccaccgaacaggctacccaacagaatattcacactcagcaaatagctaaacagcaggtaagcagggccggagagaatcagcagggcggtaataaaccacagcagatgtttgcgcagacccagtcggtcctgaataaaaccataacaaacctgggcaaagagggccgatacggataagaccgaatagatgatgccggtttgcgacgccttaaggccgacttcctggtgaagccaaatggagagaagtgaactggaagaggaccaggtcataaagaaaaagaacagcagtgcgctgagtagcaaatagctgcgggaaggccgttttttcatctacataatctcataagaaggatatgccagaatggtaacgttaacatttgtggtgtacactgcatttgagtgcaatagtcgatgttaatcacaaaagttaacgttaacatcgatgtgttgagacctcgatcaactttttgattcgggtttgcatatttctgagatttacgctgaggtaagggcatgggtagtggcacagcatccgttaatatagggatgcgtgaaaaccaggccggaatcgtgggcaggcttaatggagaggtatggcgtctttaaaagatgtggccagactggctaatgtatcgttaatgacggtatcgcgggtgctgaatgaccctgaccgtgtgaaggcagaaacccttgccagggtgcaggcggcaatattacagcttaactatgtgccggatctttctgccaggcaggttcggcgtgtcggtgccaaaaacaaaacgattggtgtgcttgcgctggatacggtcaccacgcctttttctgtcgagatcacgctgtccattgaggaaaccgcgcgcgcgtatggctggaacagcttcgtggtgaacatgttttcagatgataaccccgatgatattgtcgatctgcttcttgcgcaccggcctggcggtatcatcttcacgaccatgggactgcgcgaagtcagcgtgccacccaagctactgacgcatccctgcgtgctggcgaattgtgagaataaaggggagccggtggccagctatatccctgacgacgaacaaggccagtatcacgcggtgcagtcactgctcgcggcaggataccgccgaccgctctgtctgcatttaccgatcaaccatctggcgacgcgccgccgccgtaaggggttggatcaggcctgtcgtgaagccaatattaaccccgataatcttgatcattgttatatgcaatatggtgatgagcactaccgtgatattccggacatgctgatggcacatattcatcagggtcagccgcagttcgatgccgtgatatgtggcaatgaccgcattgcgtttatggtttatcagacgttgctggggcagggaatacgtatcccacaggatattgcggtgctgggttacgataatcttgttggcatcggtaatctgtttttgccgcctttgtcgacggtgcagttgccgcattacgaaattggtcgcctgagtacgttgcatatcattaacggggatagccaccgcaatagcgtgctggtcgacagtccgttgctgtcacgtcagtcattttaaaaatgccttgtcagccaggataagcccgaacaacgacgggcagggctgatgtcgcgctgcccgccagaaggccggtgttatttaaaggcctgggaagatttatcccagtattttaaaaatgcccgcctcattcgtccggtactgccaaaaccgcagagcctggcgactttttcaacattgcccaccccgttttccagcatcccttttgcagcatctacccgaatccgctcgaccactctcgccaccgtttcacccgtttcagcggtgaatttgcgtatggaaatccccgtgcgtaaaagacctgaaatcgcgctggtacatttaggggcatttatggatggagggatgaacgcagacatgttccccctgtcattttttgaggaaatcttcgaacgctatcctcaagagggcaacaaggcgcattttatcgaacttgtggcgaatgtgctgacgaaaaaaccgcacacagcctacctgacgtttgaaaacgatatcggcatacgcagggtcaaagattatcatccgctaaattattgcgataaaaagcctgcttatccttttaaccgctagaatttaacgcgcagtcgtatgaacgctaaccagtcatttaacgccggatttactatccagaacgcatgccagccatcgtctgatgtttaacagatgatgcatcacctggcagaaaagggagcggcaggatgaggatgcaaaaaaaaacatcacagatttttcagggccgagcgcaagtcagcagcttaaaaatgattttagcctcagtgaccgtcctgttatcgccccggcctgtgcggagggtgttttagggctgcaaaagggcatttatgtcgatacatcacaatcgtgtcgtgaccccgcgaacgccgggataaaacactatgacggggtgggactgaatagtgcacatacccacgcctgcaagctgaatatccagtctgctcagggccgcaactatgttgtcactcagcgttgcattgatgccggtgtgggggctggccctgacgtcagcgatacgtttaccctgacgatgataaatcatcaccggtttaccttcagacgaggtcagggcgcagtcacttaccgctattgtcccgataatcgtttacctgccgggcttgttgccaaatagccatcacctcacgacaacgccagactgaatgattattctggcttctgtgactggaacgagcgggatcagaagcctggacgttctgttagttcggtcacggttatgctgcctgggttttatatcgactccggcaaagcacgccctgtgatttatgccgatgaagctaatgatacattcttaaaaagctcgattcctcaacgcaaaggctatatcagatgataaaaagttacgatcatgtcgggttttcagtgagaaacatcaagcagtccttgcacttctggacagcagtgctgggcggcacactgttacgtgaagggaacatgtccggcgcgataattgatgaggtaacgggagcgcgaggcgcggatgtgcaaatggcactggttgaactggcaggcatgaaaatagagctcctgcaatatgacaatattgtggtgccggatgaatcgtcgcctccctatgcgccgggctatgcacatctggctttcagggttgaacatctggatgcactgctggagcgtgtttccctacacggctggaagacgccgggccaaccccagaccatcgccgccggcccgttaaagggaaccagagtgatatacgtgatgagtcctgacgggcagacgcttgaatttatggagtaaccggtgaaccatgaaaacgggccagcaatctgacccgttcgcaacgtctcagcaatcttaacgtttcatatggtagtacgcatcgttccagcgcagggcatctttgaaagcaggcaaccgggtatgttcatctataaccagcacttcaatgccgtgcatctcaccatacagatacatatcatccaggctcaatgcctgactgaacacggtatgatgcgcgccgccggccagaatccaggcttcagaggcggttgccagtgacggttgagccttccacagcgcacgggcgacaggcagttttggcagcggtttaggctgttcaatggcatccaccacgttgaccaacagacggaagcggtcacccatatcaatcacgctggcgttgatcgcgcggcctgcgggtgttgagaagatcatacgcgccggatcggctttgtcgccaatgcccaggaactgaacgtcaatcagcggtttctcttccagcgcgatggacgggcacacttccagcatgtgtgagcccagaactaaatcgttacccggtgagaagtggtaggtgtaatcctccataaaggaggttccgccgggacggtcgcccgccagcactttgaaaatgcgcagcagggcagccgttttccagtcgccttcgcccgcaaaaccataaccctggcccattaagcgctgtaccgccagaccgggtaactgggtcatcccatggagcgtctggaagttggtggtaaacgccttacagccttcatcgtccagaaaacgcttcaggcccagttcaatacgtgcagcatccagaacatgttgacgcttttcaccgccgacggcggccacaggggtaaagcggtagtggctttcgtactcatcgaccagcgcgttaacatcaccatcgctgacgccgttaatcacctcgaccaaatcacccacgccccagccgttgacggcatagccaaacgtgatttgcgcggcgactttatcgccttccgtgacggccacttcacgcatgttatcgccgaaacgggccactttcaggttctgactggcctgtttagccagtgcggcacgcatccagttggcaacgcgctgctggctgtgtttatcctgccagtgaccggtcaccacgctgtgttgcaggcccatacgtgcgccaataaagccaaactcacggccgccgtgggccgtctggttcaggttcatgaagtccatgtccatgctgtcccacgggatttcagcattgaactgtgtatgaaactgcaataacggtttcgttaatacgtttaaaccgccgatccacattttggccggcgagaaagtatgcagccaggtaatgatacccacacagttttgatcgtgactggcgtcgcggcacagcgacagcgcttcatcaggcgatttcaccagcggtttcagttccaggcgcacaggcagtcccgcctgatttaaaccttccaccacctgacgggcattctgctcaacctgacgtaacgtttccgctccgtagaggtgctgtgtaccaatgacaaaccacacgttgaactgttgcataaaccactcctttacttagcggaagcggaacgtgcggcataatgaggttctgccgtcacgcaccattgttgatagcgttgataaagttcctgatagcgcgcgacgcgctgcggatcgggctgcagagtgacgtcaatcgggctggccatcactttctgtgcctgctcgacgtcgcggtgaacaccggcggccacggcagcgaagatcgccgcacccagcgcacagcattcatccgaggcgacgatatccagcggacggttcatcacgtcgcagcaggcctgcatgatggcgggggatttacgggcaataccgcccagggtcaaaatgttctcaaccggaatagcctgttgctcgaagcactccatgatggcgcgagcgccaaaggcggtcgctgcaatcaggccaccaaacagggccggcgcgtcggtgccgagattaagatcggtaatcacgcctttaagacgctgattggcgttgggtgtgcggcggccattgaaccagtccagcaccaccggcaggtgatccaactgaggattagcggcccaggcgtcagtcaggtttttgatcagcgacttttgcatctccgccagctgcggcttgagttcaggatgttgctgcgccgcctgctgtaacggccagcccagcagacggctgaaccaggcataaatatcgccaaatgccgactgaccggcttccagacctattgcgccaggcaccacgctgccatcgacctggccgcatatgcctttaatggcacgatcgccgactttttcggtgtcagcaatcagaatgtcgcaggtggaggtgccaatcactttgaccagcgtataaggccgcgcgcctgcgcccactgcacccatatgacagtcaaacgcaccgcctgaaatagtgacctgctgtgataaacccaggcgctgtgaccattcggcactcagggtgcccaccggcaactccgccgtccaggtctctttaaacagcggcgaatccagctgttgagtcagactggggtccagcgcattgaggaattcaacatcgggcaacccgttccagtcaccgtgccacagggctttgtgtcctgccgcgcagcgcccacgccgcagtttatcaggggcgacggtatcgctaagcagcgccggtacccagtcgcacagttcaacccaggacacggcggcctcgcgcaccgcagcatcgttgcgggtaacgtgaaggatttttgcccagaaccattcagaagagtaaatcccgccaatatatcggctgtagtcggtaaagcggccactgtgacaaagctggttgatttcttcggcttcttctattgccgtgtgatctttccacagcacaaacattgcattcgggttttcagcaaactcaggccgcagagccagtacgttgccgtcacgatcgataggggccggggtggagccggtgctgtcaacgccgatgccgacgacggccgcacgttgcgtttcactcagcgcatttaatacgccgagcatcgcctgctccatggcgtcgatataatcttgtggatggtggcggaagcggttgctgtgaggatcgctgtaaagtccttgctgccagcgtgcatagtttgccacggcactttgcagctcctgaccagagtgacaatccaccgccagcgcacgcaccgaatcactaccaaagtccagtcccagggtgatggcttcagtacgcatttgaatctcctgttatgaataaacctccttatcctgtgatgtgtaagaaataacggttagtcatggctggctgagaatatgcacttttctgccatgagcagtgaaattgtgatccattgcaaaagttaatggacggttaaatttgctaaatgtatggatcattctgtcgtgattttaagatgtgataccgctctacatttttcttctccattcccgctaaaaataggccaacgtttaagcaggctcccatcgcggctcgcgctaacgtcctgatttacttctgtacccaaaaaagaaagttaactggtaacgtttacaccaattcgtttttaacagcgataaaacaactagcgccggagagcatcatgcataaattcactaaagcgttggcagccattgggctggcagcggttatgtcacaatcagctatcgccgaaaccatgaagctgggtttcctggtcaagcaaccggaggagccgtggttccagacagaatggaagttcgctgataaggccggtaaagatctgggctttgacgtgattaaaatcgccgttccggatggtgaaaaaaccctgaatgccatcgacagccttgcggcaagtggcgcgaaaggttttgttatctgtacaccggaccccaaactgggctcggccattatggccaaggcgcgcggctatggtctgaaagtgattgcagtggatgaccagtttgttaacgccaaaggcaagccaatggataccgtaccattagtcatgatggcggcgaccaagatcggtgagcgtcagggtcaggaactgtataaagaaatgcaaaaacgcggctgggacgcgaaagatacggctgtgatggcgattaccgccaacgagctggataccgcccgtcgccgcaccgggggttcgatggatgcgttgaaagccgcgggattcccggcaaaacagatctatcaggtgccaaccaagtctaatgacatccccggcgcattcgatgctggtaactccctgctggtacagcatcctgaagtgaaacactggctgattgtcggcatgaacgataacaccgtgctgggcggcgtgcgcgcaacagaaggtcagggctttaaggccgctgacgtcatcggtatcggcattaacggtgtggatgcggtgagtgaactgtcaaaagctaacgctaccggcttctacggttctctgctgccaagcccggatatccacggttataaaagcagccagatgctctacaactgggtgagcaaaggtcaggaaccaccgaaatttaccgaagtcaccgacgtggtgttaatcacccgcgataacttcaaagccgagctggcgaagaaagggttgatgtaacaacaggctgctcaggcagcacaggtaaagtaatcgggccacagagaacgcaggggtttcccacgtgactgcaatgggtaacaggacaaaccctaaactgccggtggcccgactcatcaacgttatttattggagaaaccatgaacactgattcagcctttctgtcgtttcatggcatcagtaaaacctttcccggcgtgaaagcgttacaggatatctcttttgagtgccacggtggtcaggtgcatgcgctgatgggggagaacggtgccggtaaatcgacactgcttaaaatcctcagcggcagctatctgccaagcggcggcgaaattcgcatcaaaggaaagccggtcaattttcagcacaccaccgacgcgctggacgcgggtgttgcaattatctaccaggaactgcatttagtcccctaaatgagcgtggcagagaacatctatctgggtcagttgccacataagcgcgggttggtaaaccgaaaactgctgcgttatgaagcgggcctgcaactcaaaaatttaggcatggatgtcgatccagacatgccgctgaagtatctgtctctggggcagtggcagatggtggaaattgccaaagcgctggcacgtaatgcgcgcatcatcgcctttgatgagcccaccagttcactgtccgcgcgggaaatcgacaatctgtttcgcgtcatccgtcaactgcgggcggaagggcgcgttgtgctttatgtttcgcatcgtatggaagagatttttgccctcagcgacgccatcaccgtgtttaaagatggtcgttatgttcgtacctttacggacatggcaaacacgcatcacgacgatctggttcaggcgatggtgggacgtaacctgggcgatatttatggttactccccgcgtgaaaaaggggccgtgcggctggagctgcaaaatgttgaagcgaagggcgtcagaacgccgatttcgcttaatgtccatgcgggcgaaattgtcggcttgtttggcctggtcggcgcagggcgcagcgaactgctaaaagggctgttcggggcgacgcgactgcgcggtgggcgcgtattgctggatggtgagccgcttaagatcggcgcaccgatcgatgcgattcgtgcgggagtgatgttgtgcccggaagaccgcaaagccgagggcattattccggtgcattcggtccgcgacaatatcaatatcagcgcacgccgccacaacctgaccgccgggtgcctgatcaaaaacggctgggaagctaccaatgctgaccgccatatccgctcgctcaatattaaaaccccaagtgccgatcagctgatcatgaacctctctggaggcaaccagcaaaaagccattctggggcgctggctgtcagaggagatgaaagtgatcctgcttgatgagccaacgcgcggcatcgatgttggggccaagcacgagatttataacctgatttatgaactggcaaacaaaggcattgcggtgctgtttgcctccagcgatcttccggaagtgatgggccttgccgaccgcattgttgtgatgcgtgaaggcgctatcgccggagaaatactgcatgacgaggctacggagcagcagacgctgagcctggctatgcctaaaacgacacaagcggccgccgtggcctgacaggagagtaccgtgacttcatccacgacatctaatacgccgccagcagcaccacgccgtggtctgcatcttggtcgcatctgggacaatttcggcatgttggtggtctttgcactgctgtttattgcctgtgctgtttttgtgcctaacttcggctcttttatcaatatgaaaggcttggggttggccatgtcgatgtccggcatggtcgcctgcggtatgctgttctgcctggcctcgggtgattttgacctgtcggtcgcctcggttatcgcctgtgcaggcgtggtgaccgccgtggtcatcaacatgaccgaaagcctgtggatcggcgtcggtgccgggctggtactgggcatggcaaccggctttatcaatggttttgtgattgcacggctgaagatcaacgccctgattaccacattggcgaccatgcagattgtgcgcggcctggcttatatcttctcggatggtaaagcagtaggcatcgaagacgagcgtttctttgttctgggcttcgctaactggctgggcgtgcctgcgccaatctggatcaccctggccaccatggtgattttcgccttcctgctgaacaaaaccacctttggtcgtaatacgttggccatcggtggtaatgaagaagccgctcgtctggctggcgtaccggtggtgcgaacccgcatcattatttttatcctgtcaggtttggtctcggctgctgcgggcatcattcttgcctcacgtatgaccagcggccagcccatgacctccatcggttatgaactggtggtgatttccgcctgcgtgctgggcggcgtgtcccttaagggcggcatcggcaagatttcatacgtcgtggccggggtgcttattcttggcaccgtcgagaatgcgatgaatttattaaatatctcgccattctcacagtatgttgtacgtggtttgatactgttggcagcggtgatattcgatcgctacaaacaaaagaataaagtctgatttggcgtgaaaccttcccgcggacgcgaaaggcgtccgcgcgtgatcaatcaacgacgaagtgaggacgttatgtatcaccgtgaattaccggcagagcagcaaaaccctttgctgcctggatattcgtttaatgcctggctggtggcgggtttaacgcctattaccgcggatggtccgctggatttctttattgatcgcccacacggcatgaagggctatattcttaacctgaccattaaaggcaaaggccgggtatttgacggcgaaaaagcctttgattgtgaacctggcgaaatgctgttgttccagcctaaaaccgcccattattacggtcgtgcacccgacagcccgcagtggtttcatcgttgggtctatttccgtccgcgcgcttactggcatgactggctgcgctggcaggatgaacaggaaggcgttggacgcctgcggttacccgaatcgctgcgtggcgagtttgatcgcctgtttgccaccattgaacaaacccataactcctcgcgccgctttgccgaagagctggcgatgaatctgctggaacgtctgttgctgcgcgcggtggaagaagatccgcgtaatcatcagcaaattcgcgatccgcgcatcattgaagcctgccagtacgtcaataatcatctcgccagcgaggtgaaaattgaagaagtggctcgtcacgtgtgcttatcgccttcacggctggcgcacctgttccgcgagcagatgggcgtcaacctgcttcgctggcgcgaagatcagcgggtgataagagcaaaactgttgctgcaaaccacccaggaacccatcgccagcattggtcgcgaagtgggctacgacgatcagctttatttttcgcgagtcttccgtaaacgcgtcggcgttagcccaagtgatttccgccgacgtaatcaggatgtgcacgataatttagccagtcagagcgcctggaccgcagcccgcagcacagtctcctgattttaaggggaatcctccttgtcctgacgagactattagtcttaaatcagtctggttagcgaataaagaggaaaaggaatgagcgagaaactgcgagttggactcattggatatggctttgccagtaaaacatttcatgctccgctgattgcgggcacgccggatgttgaactggcagccatctccagcagcgatgccaacaaagtcaatgccgactggccatccgtgaaggtggtggccgatcctcaggcgctgttggacgatcccagcctacaactgattgttatccccacacccaatgatactcacttccctctggccaaagcggcgctgaatgcgggtaaacatgtggtcgtggataaaccctttaccgtgacgttgtcacaagcacatgagctggatgcgttggcgaaagccaaagggctgttgctgtccgtgtttcataaccgccgctgggacagtgatttcctgacgttgaaagccctgttagcggacggcgagctgggcgaagtgcgctattttgagtcgcactttgaccgcttccgccttgaggtacgtcagcgctggcgtgaaatgaaagggccaggcagcggtatctggtacgatttggggccgcatctgttggatcaggcgctacagctgtttggtccaccggtggctatcaatctggatctggctgaactgcgccccggtgcacagaccaccgactatttccacgccacgttaacctatccgcagcgccgtgtggtgctccacgccagcatgttagtggcggcagagtccccgcgttataccgttcacggtacgcggggcagctacgttaaatatggccttgacccgcaggaagatcgtctgaaggccggcgattttccgcccagcgaagcgtggggctacgacatgcgcgatggcacactgacgcaggttgacggtgacaccatgaccgagaaaagctgtctgacccagccgggcaactatccggcttattatgccggcgttcgtgatgccatcaacggacgtgggcccaatccggtgacggctgaagaggcgattcaggtgatggagctgatcgaacgggggctgcagtcagccgagaaacgccagaccctgtctctgaaatagtcagagagtgaaaacctttaaaaaggccgctgattcagcggcctttctgtttactgcactttttatttctgcattttttattgcagcttcgcccgaatagccgctttttcagcttcactcaggaaggcaatcgtaagaccgttttcctgagcctggcgcatctgcgcctgactcagtcccgcagcaggtgcagcatgtcgatattcatgttccagctcaatgccctgtactgcaggatcgtcggtgttaatcgtggcgagaacgccatgctccaggaacactttaagcggatgttgtgccagtgaggcaacggtactggtttggatatttgaggtcaggcaggattcgataccgatggcgttttccgccagaaaatccatcagcgcgcggtcttcaatcgcttttacgccatgaccgatacgttcagcgcctaactcgcgaatggcctgccagatgctttccggacctgccgcttcaccggcatgcacggtaatgcggaaaccggcatcccgcgcgcgggcaaagtgacgcaggaactgattacccggcgcgcccagttcatcaccggctaaatcgacggcggtaatgtgatcgcgaaaggccagtaaaccgttcagttcgtccaggcaggcctgctcaccaaacgtgcggctcatgatgcccgttaaacgcacgtcgatatcatgctgctggcatccggcttttatgccgtcaatgacggcttcaaccacacctgcaatcggcagattatgcgtcatcgccatatagcctggcgaaaaacgcagctcggtgtaatggatacctgctctggcggcatcctccacgttttcgcgggccacgcgctggcaggcgtcaagatcgcccaacactttcacgccccaatccagcttttgcagaaagctcaccagatccggctgtgtttccgtaacctgcacatgcggacgcagggcttcaagcgtagtggcgggcaaggtcaggttaaactgacggcctaaatcaagaatggtttgtgcacggatgttgccatcaaggtggcgatgaatatcagtaaggggaagcgttgaatcaatcatggagtgcactcgtccgggtatctgtaaagtgcagaacattataaaaatatcttgcgcaacaacgccagcgatttgcgcaacaagtgagtcaggtgctgcttaattgcgcaagggaaggtgatctacgaacatgcgttttgccagttatggggcagcatgggacgttcaggcataaaaaaaggcggccaaagccgcctgattcaggaagataacgcttattctggcatgccttcgttggttggcacgcccagcatataacgcgacataaactgttccagcgtcattttatcgccattcatattcacctggccgttagcatactgcaggctggtaacgatgttgttgtcctgggtttgtgtcagacggaacatctgccccatcgccgccaggcctttaacctgctgatcggccagcttctgcgcgtcgtcagcctgataaccttctgccagtccaatgtgacgcatggtttctgttgccattggcatattgatagacagttttaaatccagcgttttcaacacgcggtctaccgtggcggccagcgtctgcggctcgccagtcactgtcgatggatcgttaaagttcgcgttcagattaaaggtgctttcacctttatcattcttccagctcagaggtgcaacgctgatcgttggcgcgccttttaacagcacaggcagattattcagcagaatggcacgaacgccagtctggaaacgtactggatcgtctgccacgccgggctgattcatcagcgtggtcagctgggcgttatagttatccgagaaggtttttacgctctgcgcatcaaactgtgacagcttcatttttaaggcaaactggcccagattttgtttttgtacttcaacgccatcaattttgtaattgatatcgccactgattttgcccgctttgttatcaaaggcagaatcaccgaccatcttgttaagaatcacagcgtcctgaccattcacggcggcggcgactttatccacgctgatggattgatcgccaatgcgcacgccttcgttggtgagatgggtatcggcgttaactttcaggccgttcagcgtaaacatgactggctggtcgacctgattcttgctggtgatagcaacgcttgcgatgtcactgtccagcgagactttatcgcctttgttatctgcactgatgttcaccgtgccgccactggtggccgcgcgctgcgccgtttgcgcattttgataatcgattggcagaatatttaccgcggtatcggtgcttccactgtaacccacgcgcgtttcagcattaatgaacgactggttgttcgtcagctcaaacagttttttgaccgcgtcggtgtttgtcagggtggtatgaaccgatgccatgctcgggatcaggttgaattttttcagttgggcgaacgggaaaggaccgtgatcgatctgctcattaagaatgatgctctgacctggttttaacagcgggttatcttccgtttgagagctcgcctgaatgaccacattcattttactgctgaaaatgccgcgttgataatcctgatagctgaccttcagacgactgttgggcgccagagtagttaactgagcgttggcattttgaatcatctgatccatattgctttccagctttttgccggtaaaccatgccgcacctgtccagactacgcccagagcaactaccacaccaacggcaacttgagtctttttcattgctgaatcgtccttatccttgatttcatccgccttgcagactgcgccagacagcggaagaagaagcgcccgcaggcattttagctaatagtttgaaataatagcagttaagcgcagtgacgtcagccgtctcagtttaacgcattaaatacacgtgctacacggccgtgacccacgatcgtcagggacggatcgttcgccgcgacaaaacaggattcgccgggttttagcaccagttgctgctggccgcagacgagcgttgcctcaccttcaatgcaaaacagcagggctgcactgtcctgacagacagaaagcggcttatccgtaaccgtatgaatggaaaatgaaaaatcatccaccggaataggaaagttgagactgttttcgtgctgttcgggttgggtcagtaactgactggccggtttttcttcaaatttcagattggccatcagttctggaatatcaatatattttggcgtcaggccagcgcgcaacacgttatcggaattggccatgacttccagcgcgacaccatgaagataggcatgcggggtttcagcaaacaggaacatggcttcgccgggttgcagggtgatcacgttgagcagcagcggagaaaacagaccgctgtcatccggatactgcacggcgatgtcggtaatggtctgccatggctcaccctggtgttgctgggctgtggtcatcaggacagctaacgcgtgcgattttgcatcgttctcaagtgagagcagggtggaaaacagcgcggccaggctctccaggttaggttggcgcaggaactgcgcaatctgcggatgcgctccggcaaccggctccagcagtgaaaccatctctttcagttcgcgaaagccgttgatggctttaaacggcgtcagcgcataaaccagttcgggtttgtggttagcgtctttgtaattacgttccgcggagttaagtgggatggaagcggcattttcccgcgcaaagccctcttcggcggcgcgtttgcagggatgcacctgaattgacagcggctgatcggcacacagcaccttaaacagaaaaggcaattcgccaaagcgcttcgccacggcatcgcccagcatctgctgcggattggccgcaatcacatcacgtaacgaacggggcttgccatgttcttctacagtcgatgggctttttgggtgcgcccccatccacagttcagccatcggcaactgcttaggattcgccatgccataaagcgacgttaatgctgttttactgccccatgcataattttgcagagagttagccatttttttcatgaaattaattgccttactggcgggaaatattgcgcttattaaaccagaaactgacatggaaaatacatatccagcgcaagaaggatgctaagctcggaggatgttaataaattgtataggtttaaccgcgtcacacaggctttaaccggcaatgggtgacgcgacgtcttatctaaaactgtgctaaggagagaatcatggcagccaatcgcgttgaaaaagattcaatggggccaattgatgtaccggctgagaaactttggggcgcacagacacagcgctcactggagcatttccgtatttcgacagaaaaaatgcctgtcgcgttggttcacgcgctggccatgaccaagcgtgccgccgccagcgttaaccgggatctgggtttattgccagcggagcgggctgaggcgatcgttaacgccgccgatgaggtgttagcggacaagcacagtgacgagttccccctggcgatttggcagaccggttccggcacccagaccaacatgaacatgaatgaagtgttggctaaccgcgccagtgagctgctcggcggtgagcgcggaatggcgcgtctggtgcatcctaacgacgatgttaacaagagccagagttcgaatgatgtgtttcccaccgccatgcacgtggcggcagtgattgcggttcgcgaacatctggttccacagctgaacgtgcttaaacaaacgctgagcgccaagtcagaagcgttcaaagacatcgttaaaattggtcgtacacatttacaggatgccacgccgttaacgctgggccaggaaatctctggctgggtcgccatgcttgaacataatcttaagcatattgagcagagcattccgcaccttgccgagctggcactgggcggcacggcggtgggaaccggcctgaatacccatcctgaatatgcggttcgcgtggctaaagctttagccgatttaacccaacaaccttttgtgaccgcgccgaataaatttgaggcgctggcaacctgtgatgcgctggtacatgcgcacggggcgcttaaagggctggcggcgtcgctgatgaagattgccaatgatgtgcgctggctgtcatcaggcccacgctgtggtatcggtgaaatcgctatcccggaaaacgaaccgggcagctcgattatgccaggtaaggtgaatccaacccagtgcgaagccctgacgatgctgtgctgccaggtgatggggaatgatgtggcgattaatatgggcggtgcgtcaggcaactttgagctgaacgtttatcgtccgatgattatccataacttcctgcagtcggtgcgtttactggcagatggcatggacagtttcaaccaccactgcgccaccggtattgaacctgtacgtgagcgaattgagcagttacttaacgagtcgcttatgctggttaccgccttaaatacgcatattggctatgacaaagccgcggaaattgccaaacaggctcacaaacaaggcttaacgcttaaagcctcggcgctgaagctgggttatctcactgaggaagagtttgatgcctgggttcgtccggaagagatggtcggcagtatgaagcagtaagtcaggttcatcagggccagcacggccctgatgtcataccggacaatccacccataaatgcagtcggggaatcagcaaatacagcggttcagcggcaggcttatagcgatgcgtaatattgtcggcatcataattcaacagttcacctaactggggcacctggctgcggtcgcgacacagcaccaaaatcggtgacggacaggccaactgggtttgctttttctcttctgcgcgccagacccgcgcgataggctgcactttgaccggacgcttgattttaagacgcgccgaagcgggaagggcacgcacatccgccagctcttgctgcaccttttctgcccactgttcacgcgtccagggtgcctgtgcgcgaccggctttcaggcttttttccagttgagcgacaatctcttcccgtttcacgtttttaatgacctgcttattggcccaaccaaaacgtaaactttctggtgctgtgatagcggtaagggttcggtaggcattaagggtgatcagcccacgtaaatgctgatgaacaaattcaaagcgggcttcagagggcaggccggactccacggtaatcaactgttccagacgggctttactttgattgatccccgcgatacggccggtcagttcacgctcttcctgttcgttgcattcaatgcaaagcgcacccggtaagcgcacggcggctttagtgctgagcttttccgactgatgttgcataaacaaccgacagtagtgattaagtgccatctcgcgtgccgcaatgccaagatgctgctcgacggtaatctggctgatggggtcatgttcgtggcctttttcgaccggcggtaaacgaaagacccgggcaatcaacagcggaagcgactctgtctgctgacggagttcccccaatgcctgctcaagatcctttacgcattgctgcatgtctgtcactaaatcgtagcgcactgttgtcttctccatagttacaacatgcttactgtggcagaacggttccttctctgcaatagcgcttatagttacaacatacttttagtcaggcaatgaaaaccgtgccgccagcccgcgctgacagcaaaaaagccatcagcaacatttttcccctatgcattaacatgttataaaaaccctttgcctgctaacggatgcccgacatggacgtaatgaaaaagcctggttcattcagcattatccttatggggctggttcagatcgtctcatgggggggatctttctacctgatggcggtgatggctgcgcccatcgtagcggaaaccggctggtcacaacagtgggtttatggcgcgctgtcgttgggtattctggtctccgggctgctggcaccgcgctgtgggcgcatcattgcacagaccggcgggcgtttgatgctggcattaaacgggctcgtcatggcagcagggttaaccctgatggggttcagccataatttacctgtatttttatttgcctgggtgatcattggtgtgggcatggcgatggggctgtacgatgcactgtttgccacgctgggcactcgctatggcggacacgcgcgcggtgctattaccggcatcacgctcatctctggattctgcaccagcctggtttggccgggcacggcgctgcttattcactggtttgactggcgcggtgcctgtttcgccatcgccgggttgttgctggcctgtgtcctgcctgcctatctgtttgcgttgccgccaggcaagccgcccgcaccggtaaagcgtaataaaagtccgcacggcgctgaagcggattttcctgtggtgctgttccgcctgctgtgcgccatttttaccctggcatcggtgatcatgacggcgatatccgttcagttaatcacgctgctggaagcaagcggttacagcctggcctctgcgctagcaatcagtgccattctggggccgtgtcaggtggcgtcgcgcattatcgatatggcttttaaaggcgggcatcccatctggaccacatttttttcagtgggactggtcgcgctgggtttattgctgttggcactgtttcctcaaacggcgctgttcagcatgatattgtacggcgcgggcaacggcctgcgtgcgattgtgcgtggcaccttgccgctggtgatggttaagccggaagcctatgcggtactggcgggcagaatggcgcgtccggcgctgatcggtcaggcgctgacgccgctggtgtttggctatgtgtttgccacctatggggcaaacgtcacgttgtggctcctgtgcgtgctggccgtgcttaatgtattgctggtggtggcgctgaaaaaacggcttcccgcgcgcgtcagtgctgcaccgtaagcgaatcggggaagtggcagggcggtaagcaccttgtgctgtcgtgggccttatgctggtgaatatgtgccttgtcgcgggcctgttgcttctaaaaagtaaccgtgtttgttatatttacagctgattcattgttcactcatgcggcaatacaacaataaaaacgtaccgcaactcaggatacaaagatgcttgattatcgcttcccgacagctttgcaaatggttctgagcgtggcgatggcggagcaaatgggaaaacgctctaccagcgcgattctcgcttacgggcttgaagcaaacccaagttttatacgcaagttgatggtgccattgacgcgtgacggaattatcgtgtccacgctgggtcgtactggttccatccatcttggccgaccggcggcggatatcactctgcgtgatatttatgtctccgtcaccgatgacaaaaaactctgggccgcccgcccggacgttgccccgcgctgtctggtcagcgccaacctgtgctggtattttaaatccatcgcagaagaagccgagcaggcatccctggcggtattagccaaacgtaccgttgcggatgcgctaaatgagcttaaaacccacgataccagcaactgcaccgccgtgcctgagccggatgtggcagagccagaaaacctgtgcaaaaaaagccgctgatgcggctttttttatatcctgaacctgccagccgctaaatccgtcatacggatcagtaactgagcaatcataccgccagctgaaaaaccacacgcatattaacgcccgcctgtacttcactcccttcatccatgatgtcgttatcgacccacggcctgttcgcagtctgcgatgatacgtttgccagcttagccatcttggttgcatctgttcacttcgtcgcgtgctacacaacctggcgttctgtggcaaatgccttttcgtcggtgttaaaccatgctcgcttaaacgcaccagcccctgacaggcatggcataatctgtgcggctgcacatcaggcatcaggtggtgcggttcaggaaaataagcgagcaaaatccgatccggacgataagattaccgcccggatcaaaccgattattgtggattctgtaaagcgtgatgcgcggctttacgcgtcaccagcttacgcagcgccacgtagaacaccggggtcagaaacagaccaaacagggtgacgcctaacatgccggaaaataccgttacacccgtgacgccccgaacttcagcgcccgcaccttcacccagaatcaggggaatcgtaccggcaatgaaagcaatagaggtcatgacgatagggcggagacgcaggcgacaggcttccagcgcggcctcaacaatgcctttaccctgaatctccagttcacgggcgaattcaacaatcaaaatggcgtttttacaggccagccccataagcaccaccagtccgacctggacaaatacgttattgtcgccgccggttaaccagacgcccaccagggcagacagcatcgtcatcggcacaatcaggatcaccgccagcggcagcgtccagctctcatacagcgcggccagcaccaggaacgccagcaggacagcgacagggaaaacaataagcgccgtattgccctgcgtcgcctgctgatagctgagatcggtccactcaatattcataccgttcggcagtaactggccggacagggtttcaagttgacgcatcgcctgagcagaagagagcacgcgcggatcggcatcaccgattaagtctgctgccggatagccgttataacgaataaccggatcgggtccataggccgtggtgatgtgcaccatgctgccaatgggcaccatttcaccgcggtcgttgcgggtacgcaggttcgcaatgtcctcaacgctgtcacggaattccccatccgcctgcgccatgacgcgccaggtgcggccaaaacggttgaaatcgttaacataggatgaacccagataggtttgtagcgtactgaacaacgcggtcagcgccacgccctgagctttcgctttatcacggtcaacctgcacctctaactggggcacgttggcctggtaagaggaaatggggaagtgcatgcctggcgtctgcatcaccgcacccgagagggtgttaatggcggtttgcagtgcgccatagcctagtccggcccgatcctgcacgtacagggaatagcccgaaccctgacctaatcccagaataggcggtggcataatcgaaaagccaaagccctgttgaatgcgggaaattttcgcattgatctccgcattaatctgcgccgccgtttgtttgcgctcgctgaagggtttcaggccaaaaaagaccgtgccactgttcggcgtgttggtaaactgcaacgcattcaggccggggaacgccaccgcgtaagccacgccttccgtttgcaggccgatttcgctcatctgtcgaatcacttcatcggtgcgcgctaacgacgagccttccggcatttttacgccaccaatcaggtaaagtttatcctgagtaggaataaatcctcccggtacggcatgaaacatccagcctgcaccaaccagtaataccaggtagacgccaaacacggcaccgcgacgacgcagcgttttttccaccatcgattcatagccgtgcgcgctgcgctgaaagacgcggttaaacggacggaaaatccagccaaacagccgatcgatcaggcgcgtcggcatatctttcggggcctgatgatccttaagtaacagcgcggccagcgcgggcgaaagggtgagcgagttaatggcggaaatgaccgttgaaatcgcaatggtggtagcgaactgcttgtaaaactgcccggtcacgcccgacagaaacgccatggggacaaacacggcacacagcaccagggcaatagcaataatgggaccggagacctcacgcattgcctgatgcgcagccgccttaggtgacagtcccatctcgatattgcgttcaacgttctccaccaccacgatggcatcatccaccacgataccgatggccagtaccagcccgaacaggctcagcgtattaagcgagaatccaagcaaataaagcacgctgaatgtgcctaccaccgacacgggaaccgccagcaggggaatgatcgaggcccgccaggtttgcaggaacagaatcaccaccagcaccacaagaaacaccgcttccagcagggtttgcaccacggccttgatggagtcacgaacgaaaacggtcggatcgtaaggcgcggcccacttcacatcatcagggaaacgggttgccagttcgtccattttggcccgcaccgcattggacagatcgatggcgttggctcccggtgcctggaagataccaataccgacagcgtctttgttatttagctgcgaacgcagagcatagctgcccgagcccatttcaatacgcgcgacatcacgcaggcgcaccagcgaaccgtgttccgaggtttttaggatgatatcgccaaactgctgctcgttttccagccgcccctgcatattgatggacaggagaaaatcgctctgtttttttaacggttctgccccaagttgcccggcggacacctgcacgttctgctcctgcatcgcgttcacaacgtcagacgcggttaaaccgcgcgccgccactttattcgggtccagccagacgcgcatcgcgtattcaccggcaccaaaaatctggatttgcccaacccccggcaggcgggccagctcatctttcactttcagcgtggcgtaattgcgcaggtagagcgaatcgtatgtgttattcggggaaaacagatgcaccactaacgtcagcgttggcgacattttttgagtggtgatgccgagccgacgcacgtcttccggcagtcgcgcctcggcctgagccacgcggttttgcacctgaacctgcgcctgatccggatcggtgccaggacggaaggtcaccgtggtcaccaacacaccgtcagaaccggccaccgacttcatgtacatcatgttttcaaccccgtttatcgcttcttcgagcggggtcgctacggaatcagcgatcgctttcgggttagcgccagggtattcagcacgcacctgtacgctgggcggcacgacatcgggatattcactgatgggcaacaacgggatagcgatcagtccggtaataaaaatcaatacggacagcacggcggcaaagatcggccgatcaataaaaaagcgggaaaaatccataacaacctcagattattgagcggcagtggcagccatatcgacagtttttgccgttaccggcataccgggcataaacactttttgcagtccggcaacgataacccgatcgcccgcctgtaaaccggcggcaacgatgcgtaatccgtctgccatcgcaccgggcttaacgtcccgacgttgggctttcccctgggcatcgaccacatagacatatttgcgatcctggtcggtcagcacggctttatcgtcgaccaacagggcattaaactgcgcgctaccgggaagacgtacgcgggcaaacaggccgggcgtataggtgcgatcgcggttatccagcagggcgcgcatacggattgtgccggtgctggcgttgagttggttatccaggaagtcgacgttgccacgatgcggatatccctgttcccctgccagggcaatttcaacgggcagggcatgccgttgttgtccctgacgcgccatcgcctgatagtgcagaaacgtcgtttcatcgacgtcgaaatagacgaacatcttgtcctgcgcgaccagcgtggtgagcacgctggcgctgtcaccggcggtgaccaggttaccgctggtgatcatggcccggctggcccgaccgtcaatcggtgcggtcacgcgggtaaaatccagattgagctgggccatagctacagaggactcagcggccagcacatcggcctgcgcctgactggctgtcgaacgccgctgttcccacatctcgcgcgatacggcctgagtcccgactaacttctccgttcgcgccgattcgcttcgggtcaggctggcctgactccgtgcccgggccagcgtcgcttttgcctgttccagcgccgcgcggtagctgcgatcgtcgatggtaaacagcacctgaccttttttaacctcatcaccttcgtgataattcacgctatcgatataacccgaaacccgtggccgaagctgcacgctttctacggcttcgacgcgcccgttgaagctgtcccattgactgacaggctttaccagtacatctgcaacgctgacctcgggcggcggcggcggtgcattttttgtctggccggtgtcgcacccgcttagcagactgaccaacagtcccattcccagtagggtagatccctgacgaacccagttagtaatcattgttgtgattccgcgatgaacagtgaaatgaagcccgcaggccaacatttgcaacttctatggttgcaatttatcgcgaggagtgtaggcttgtgcgtcaaagaactgcaagaattactgatacactttatgtgcggtatgacaagccgaagaaatcggcctggcggtgactgaaaataagccccataaaaagtgcggcatttaatgtattaattaaacttgcattaagtggcattgtcatccacgcttttagtgtaactgcaactgatactaatactgttcgctgccgcgacgggagactaaacatgatgagtaacgcttttattcacgaccttattgactggatcgacaacaacatcgaagcacgtctcgatctcgacaccgtttctgagcgcgcgggctactcaaaatggcacctgcaacggatgttcaaagagcacacgggctatccactgggtgaatatattcgcattaaaaagctgaaaaagtcggctgaccgcctgaccagcaccaatgaacctatcctgaatgtggcgatatcgctgggttttgactctcaacagtctttcaatcgcagcttcaaacgacagtatggtgtggcgccgggcgcatggcgtcgtcacagcgtgccttctcaggctgccatgcagtcaatgcagtaaacaccgccggggccaggtaatctggcccgcgctttttgatcctcaggtaaagctgctatcatctgcatcctgtttaaagggatgccatcatgtcaaaaaaactgtgggttgggctggttctgatccttgtcctctgttgggtagggttaaaaccttatttgacctctgcaccagccaaaacgtctgcgtcagacattgctgcccttacggatgtgcgaacggtcgcccggtgggtcctgcagcatcagcaactgcccgattattacattaccaagaagcaggcccgtcgccttggctggaatcccgcgaaaggggacttgtgcgaggtgttgccgggtaaagctatcggcggcgatcgtttttccaaccgcgaaagaaaattacctgaacgttccgatcgtcagtggtttgaggccgatgtgaactaccgttgcggtcaccgtgaagccgaccggttggtttactcctccgatggcctggttttcctctctaccgatcactaccgcaccttcaagccggtcccttaatcatgctgaccttacgtttcgacctgcgtcagatcaccgagcgtgatgccttctatcgtgcgtttgccgcgcagagcggttgcagcgctggattcggcaacaatctggatgcgctatgggactggctgaccggaggaatggcgttgcccgccgagattcatctgctgcatgcagaacagtgtcatgccgagctggcacctgtggtggcgttgctggaagaggcggcgcagtcgctgtcgggcgagctgcgcctgattggcagttagtggcgtaacggtttgagcagcgcggtgagtgactcgcgcgcggcgaccggcagatcgccaccaccggtgtaaccgttgttctcaataatcaccgtgttcagccccaccagccagtcgtaaatataataggccgtatggttagcgggcgcggcagaaagcttcgtcagtcgctgacctgcgctaaaattcacgctgggcgcgggcggacgcgaaaaaatcgactgtccccgattgacccggcttcccggacgttccgcttctggccgctgaagaaaaccaagccaggcgacaaaatcccccagcaccgtcatcgcgcgggttacctgacggtcggcacgtgattcgtgtgtcatgctctgtgcatccggttcatgtaacgcctgctgcagggactgcagaataccggtgcggaagctggccgtaatcagttcttcgatcaaccactccatcgtcgctttatcaatattcagcagggctaacaggctctggttttccggcagctgacgcaggtggttcagccacaggctaaaaacctgacgtggaaactgggctgaaccctgaccgaagctggtctgcttaggggcaggctgttcaacttcggcatcgctgaacaaatcaaactcaaagccaataccaaactgattttccggtgcctgaatactggaggtcgccgccggaacagacgaggtggactggttgagccacagctggcgcaaggcttcgcgggacggctgtaagcgctcaagcagttcgccatgcaaaccggtacggtgttgtaaacatttcagcaaggtgtcggcgatgctttgtctgcgtgccgcctggtctggcgacgcaccggcttccgtccagggctgcagtcggcgctcgactacggcgtgctggatttgtgccaactgggcaatcagcatatcgcgacgtgcgtcgggctgcatctcttcctgcagccagtcagacatccgatccacgcctgcgcgatccagggccagcatagaaccccactgctgacccggttgtcccacctggcgctgtaccgcctcgtcaacattgatctgctgatggcgcgcatcgtaaggcgtgatcgcccaaatcaggcgaggtttttcacccgcttcattgaccggctggtggcgctgccattcacgcaatgcccgactggcgacatcgacatcctgacgctggctggcggcggtacagatcaacagcaggtcgatactttgccgggcggcatacaggcccggtatcaggattcgtttgtgctcaagcaggcgcgcgcgtaacgcatcctgcttctgcagacgctggcgctcttcacgcagcgccggatcgctcggcgtcccgggtgcaggcagttccagcatatcggcatcgtcatacagcgcggtgcgcggggtggagctgagtgggatggtgacctcaagcgttagcagggccagtaatcccagcgtcacgttctgcggcttacccagacggttaccgtttaacggacagacttcaaccgacagcgactgatcctgctcgctggcgggaacgatcaactgctcagcgggcagcagggaattatccgtcagcagactgagcggagccagtacccgggtgctgttacgcagctgatggcgtaagtgcagtaagcttcgcaccagctcattcagggccggctcagcgggccacagcagtgaaaacagctgcacacggtcatccacgctcagccagggagccagttcaacagcctgcggccagaaatggcgatccaactgggcgtcatacaggtgatgacggcggcaccaggaccagagcgtgaccagtgcatcgctctccagacccggcaacggcgtagttaaacgatggcgttgcaggcgttgcagcacgctgtcaattttcgcagtgtcgggctgcgttaccccttcaccacaggagatggccaaacgcaccacctcggcctcgctcagcagcgtcagctcgaccggccactccgaggagaggatttcacgctggtgggtaaaacgcgttgcggtggcaaaatcgagattgccggggttgacgtgctggaaataattaatcggtttatcgctcagcgcggtgatcaactgaccttgtgcgtcagccaccatttccgtcagcagccaggctttgcccgcctgcgactgtccaaacagcgccagcgtcaccgggcgcgcaacctgctgcgccagggcctgcgcctgcacacgcgcctgccgtaactgcagggtcagggtttcggcttccagtgccagccgcggcgactgttcgcgcgtgctctcaatccaggccaggctgccgttcagggcgtcctgcaataaactcaggcgttttgccagcgtctgcggctggcggggttttaccgatctcatcgtttacacacactcccgctgtcaatccagtattgcgcattggcattgcccgtggcggagagagtattcagtttgaggctcagatgttcaagtggaacacgcgtaccatcatccagtttggcttcgcttaacaccagattttcagggccgggcgcacccggaccggccttcactgccagcttcacgcgcagaacgctttcacctgcgaccttgcgtgccagtgccgcatcgttgagcgtcaggctgtacagtggcgaggcgggccagcgttcattatctaactggcggaatcccaggcatacgttaccgcgaatgcggaagctgcttttacggtccagcgagaactggtgatcgtcgagatcgatgtcgctatagcagaggttctcgtccgtcagcgcctgattttcgtccagcatgcccagatagcgaatggtggagtaaggctcaaagtcacctgcacggaaccagaagctgctcaggcgtaaatccagcgccagcagacacagcatcgcgccgactgcggcggtcgatttcgggttatcaatacggccgtgcttattaaacggataccagtcactggtgtgatagccttcgagcgacagaatacggctacccggcagtggctgtagatggcgcaccagtgcctgaatgcccgggaaccgcgacggacgtccggtcagtagcagcacatcgcactgatagagcgagaccacttcacacatggagcgcagggccggaataatcgccatgcggtgctgcataaactcaccgtgaagctgggccatgctcacgaccagcggcacctcaagcagatcgaaacggctgttaccgcccagttctcgctgaatttcaccattaataaaggcaagcaccgcatcggcagggcgctgatcgaccagttcgccaaacagggcgttgatctcggcatggctttccagcgggtcccagttttcgtaccgttccagcaccgcctgagccagcgggataaacagctgtaacgtggcctgctggcgtaacgttgcctgtccatccatgcggctgtcgtgaccaaacagcttgttgatcagcggctcagccagcgtcagtcctgctttttgcaggctctgctgcagtgcaggcaaaatccacagctgaatcacatccagtaaaatatcatcaccggccactttgaaaccttcgcgaaacagcaggcgcggggtgattttgacgttgttgccctgaccgtcgtcaagacggtactgggtaatggctaaatcggtggtgccgccgccaatatcaatggaggcgatacgcaggctcttgcctggcagctcgtcggcttcgcgcggacggtcggggcgcgccatgctgctaaagaaatcttctgcacgaccggcaaagttaacctgggtctcgttaaacagccacaccatctggccgcaggtcgcttcgtcccactccatctgcacatccggcacgggtttgctgctttgggcctggctctgttcggtaaaatcctcgtcagccggatgccagccctcggctttccacaccagcgcgatggcttcctgcatacggcggcggaatatttcacgctcgggttttggcatggcggacggcagcgtcaaaatgacatggcgcagctggcgcggtgcatggctttgcggcatacgctgacgctgtgccgcgctgttcatttgcatcagcgcctgggccagcaactcacacagcataaaggtcatcagtgaactgcggctgtagtgggcggagaacacgggtaagcgctcatccacgggcagcgcatacagcggctgaccttcgtcattcatcaatgaggtaaaaggtgcagcacaggcctgaggctcaccctgcggactctgctgattgaagcgccagcctggctggtagcgtgcttcgtcccacaggtaacggcgagggctggacaggccggtactgccttccagaccggcacgctgcagcgccaggcgactggcttcacgtccgacgcgagttaacgagggccacataaaggcctgctcgcggccgctttccagcgaaaagttagctttaccaaaacgggcttcggcaaattccagtcgactgtcgaacagttcgttataaacccgatggggatgagacagatcgcgcatttgcagctcataggtctgcttcaggccattgctctcttccgggtgatcttccacgaggatgccgcaggtgtgggagttccccacgtcgagaatgatatcgacattgaccgccggcgtttgcagcgtggcggcctgaatatgaatttcagtaaggttaagctgttcgcccagcaattccagcaggttgaggtagtgcgcctggtattcaaactcacgcagagcctggctaattgcctgttcccggcgatcggatacgcgatccgtgaaggactcgcgcagccagccatccacccacgtatggtcaagaaaatcgcccagctcgtagttgtgccaggccagcgcaaaggtgacaccgttttgcgcatcggagggcgtcagtcccaactgctcgccgccgtcttcttcaggcacgcagcgggtatcaaaagccagggtgacgcggtgcgtattgcctgtactgtccggcttatccagggcaaccagccgcatgcgcgcccagttttccgggccgccaataaaacgtcggcctgatgcgcagcgcagcatcggcagcggtagccagcatgcttccagcagcgtcagggagtcggccagggcgatatcggtttcagggcgcaccacttccggcgcaccgccgtcctgcggatagagtaaaaacttaccgctgttgccgtctacattcaggcgcagcaacgggccgttcgcggtctggcgcacgaactggcggcgcgcctgagtagcggaaagttgcagaccaaaatcaagaaactgtacgccactgttctcaatcagtgaaatcttctgcttatcatcgatcaggggagccaacatagttacttactctcacgcttaatcgtaatgggatacgtacgatccccactgtactgtgcttcacatgctgccgcgccaatgctggaatgacacactaacaacggcatgcgataacgcgatttgtccgcgcaccgggcagtaaagcggctctcaatcaccagattaccggcgctggtcatcgcagcagtcacatcagccttacaggtggtgttgccctgattaatctggacgttgcctttgccgtttttgaactggaagcgcatgacaggcggtttaccggttggggttttgacctggtcaatctccacgcgccagcgaccatcaatgacctgtacctgaccatcgcgaacggcatccggtgtcaccaccagatcctcgggtttagcgggcactgccggtacgacgacgtttgaaagcgtggatgacggggcgctggccgttgctgtcgcggcgtttgccaccactgcggccggtttttgtggcagcgtggcggacagtttttcagccgaagccaccaccgccggaggcttactcgcgataaccggcgcaggagccgggctgttttgagcaacgggttgcgccgtggtaaccggttctgactttggcatatgtaaaataacagccgtcgctgccgcagcggccacggccacggccagggttgggatgagataccacaggcggaaaggccgacggcgcactgccgtcacaggcaacggttcagctgcctgaacagggacatcactgaccgtcggctccgtaacctcgggttcaggtgtcaccacaggttcaggttctggcgcagcagccacggcgacaggctcaggtggcggttcaaccagcacagtgggcagtgactcttcaaggctgtcacgcaggcaggccagcgcatcatcacgattacgctcctgagcatcgacaaatccccaaaaggtaatgacgggtttaccgttaaccagatacacatattgctgattagggaactgcaggcttttgcctaacagcgcaccaaacaggcgcatggccggattagctgcatcgcgtgcgcgggcgctgatctcctgcaggtcctgctggcaggcggtgaggtgttgtaaagcctgacggcgttcataatcgctggcacccatccaggatttcactttgcccgggaagggcgagtaccagtcaagccggtcgccacgttcattggtttgtggaatggccaggcaatttgccagcgcgctttgacggcgcaaacgcagggtttcacggatttgcagggcggaagcaaatacaggctggccgttctcgcccaaagccagaaccgcatccagattgccgctgcgcagaaaagtttttgccacctgttaagcccttatcggtcgttgtctgaggcagaagatcgcgtgttatcgtcgattacggtgattttacgtgggacaatggcaaatcaaaccgctgaaaaaggggataaatgcgtggttttttgacccgctgccgggaaaataaccaatgccctgatgatgttacgctgttttacgctttaataacagatgtgcaaccacgccaccaaccaggccccaaaacgccgaaccgataccgcagagcgtcacgccggatgcggtaatcagaaaggcaatcagggcgctgtcgcgctcgtcgggcgtatccagcgcacgttgcaaactgccgccgagggtggcaagcagggccagaccggccagaacctgaaccatcacctcaggcagtgcgctgaacagcacggcaatcaacgccccggataatccggcgagcagataaaaaaaaccagccagcgccgccgctatccagcgtcgttgcggatcggcatccacctcttcgcccatgcaaatcgcggcagtgatcgctgccacacaaaccgaaaatccaccaaacggagacagcaccagggccagcagcccggtccagctcattaatgcggagatcggcggtcggtagccgtgtgcctgcaaggtcgcaatgcctggggcattttgcgaggccatggtcaccagaaaatagggtagtccaatacccatgagcgtgggcagtgaaaaggtcggccagacaggggcgggaaggctaaagcgcgccacatgctcagggaaatgaatgctgccttgcccaaaggcgatggcaaggcccgccagcagggcgataagaatggcatagcgggcgaaccagcggcgtgccagcagccagataaaacacattgatgcggccagagtgaaattaactgataaatcgctaaacgtctgcaggccaaatcgcagtaaaatccccgccagcatggcggctgccagtgaggcgggaatgtggttcatcagccgggcaaacaggccggttacgccgcacaacacaatcagggcgttggcaaaaacaaacaccccgacggcatcgttgacagaaaccccttgcaggctggtcgcgagtaacgccgcgccaggcgtggaccaggcggctaagatcggcatccggtacgccagagacagccccgccgaggcaatgcccatcgcaaggccaatcacggaaagccagccggcgatctgcgtgggcgatgcgcccgccgactgagcgacctgataaataatcgcaccggtactgctatagcccaccaacacggcgacaaagccggaaacggccatgggcaaggtaatggggaacggcgcgcggcgtgcagacatgatgtaaccctctcgtgcgttatagcgcacatcgtcgcacagggcgttataacgcacaagtgttacactgaagcggtacagcaggagacaacatggaaaatttgcagcaatatcttggcgatgcgctgaaacaattgcgccaggccaacggctggagcctgacttcaaccgcggaaaaaacgggcgtgagcaaggcgatgctgggtcagattgaacgtggcgaatccagccccacggtggcgaccttgtggaaaatcgccaccgggttcaatgtcccgttctcattttttgttcataacggatcgctttccgccggtgaggtggcaagttaccgacagcataatgcccagatgacggtcacgccgctgttaccttatgacgaacgactgcgttttgatttgctggcagttgagctggcagccggtgcacaaagcgattccgcggcccatgagcacggtgtgattgagcaggtggtggtggtggaaggggaactgttactgggcatcgaagatacctggcggcggcttaaacaggatgaggcctttcagttcagggcggatgttgcccacagctaccgtaatcccctgaacagccgcttacgctttcacagcctgattcattaccttgggcgaaactgagcttacaaattgaaaccagccgcgcctgttcagacctgaccggcatttgtatactcagtccccctttgtaaggccgcgctgcacgcctgtttgcacctcgttgcaaacgctgactgcctgagcgtcgcagtctgcaccttactgactcgttatctgttaccgcttccagaggaattatcatggctttaaccacacttgatgcgaaaaccgcgctgatcgtcatcgatctgcaagaggggattgttgcgctgccagttgtgcatgagccacagccggttatcgaacgctgcgcaatgctcgccgctgcattccgtgaaaaagatctgcccgttgtgctggtcaacgttgctggcggtgcgccaggacgcaatgagatgccgcgtcacgaaggcgagctgcctgcaaactgggcaaccctggttcctgccatgacaccgcagcataacgacctgaccatcaccaaaaaaacctggggcgcttttcatcacacggcgctgcatgatgagctgcaaaagcgtggcattacgcaggtcgttatttgcggtattgccaccagcattggcgtggaatcgacggcacgtcaggcgtatgaattaggttacaacgtcactttggcggtggatgcaatgactgaccttaatagcgacacccacgaaaacagcatcaagcgcgtgtttccccgtctgggcgaaacgggcagctgtgatgatgtgcgtgcaaaactcaacgcgctataatcgctaagcaatatcccagggattgagcagcataacgcccagtccctggaaatctttcaggttacgcgtgaccaggattaaatcgtgctgtagcgccgttgccgcaatcaacgcatcggtttcagcgcgccggtcgggcacgtgcagttgggcgcagcgccgcgcgatggggccatcaacaggcaaggttcgctgacgatacgcctcaagtacctgtgtctgataccagaggcgcaaacgttgggcctgctcttcatcccgctgttcaagatgcaaaatccctctctctatttccagcaacgtcagggcggaaataaaggtgttgtcagtgctgaccgtgacagcccaggcttcgacgtttggatcgacgcgcgctgttcctgccttgcgcaattcggaaacgacattcgtatccagtaaatatcgcatcagaaatcgacatcccgcgcggtaatacttaggcgttccggtgtaaaatcaatatctgctgtttcaggcatggctaatgccatcgccagattttttttgccacctgttaatgtttgataagcctcaaacgttaacaggacatgtgcgggtttaccgcgatcggtaatgtacactgggccgtcctccgcctcttttttcgcctttgacacgtcttgattaaaggcacgacttgaatagattttgttcaacgtgagtgctcctcacatgtagttacgttactacatagagtttatgtgagtggatctttttgagcaagttttgaacgaaacctcgagtgctctcgcaaaatggcacagcggaaaccgggatgggtgggtgatacgatgaactgactgacgacagcgagatgccagcgtcaggaaggatagcggagagaggccaccagagcggcggccgcgtgatagcggcgcggccgccctgtattactggaaagcgtaactgaccgtcaggcccacgctgtagttgcgcccaggtgccggttcgaaataacggctgttactttcgttgacgatcaccgagcccacgtaattccggtcaaacaggttatctacccgcccaaacagatccagtgtccagctggcaacctgccacttatagccgctgttcagcgaggtaatggcgtaagagggcgcgcgaacgtcattgctgtcatccgccgcaatattgctcatgtaacgccattctgccccggcgtaaaaaccctgttccggggcgtaagccagcccggtataaagcatattgcgcgcgatgccgggaatacgattgccgttgcagctgttgtcaccacaggcattggtgcggtagcgcgcatccagcagggtgtaagccatcttcagccgccagtcatagttaaactgctgatcaaggcccagctccaggccacgacgccgggtttctcccgcatttttataggtggtacgcccgccgctgctgctgtcagccacaatctcatcctgggtatcggtctggaaaatggcggcgctgaccaggccattgcccagccgttttttagtgcctaactcaaccgtgtcgctggtcgcgggcttcagccccagattcagtccagactgtccgtctgaacgataggacagttcatttattgtcggcgtttcgaagccgcgtccggccgacagataggtgttccagctgtcgtcaaaggcgtacttcaacgcggcggcgggtagccatttgtggtaacgggcatcgccactgtcatcgccattacctggcgtaatgtaaacatcgttggagtcaaaactgaccgtactgaaacggatgcctgcatccagtgaccatttttcactgagctgccagctggtttgcaggtagggatcaagattccacatcaggttgcgttcgttgcgacgcatatttccctgttcgccaaactgcgtgacgccgtttaccgtggtgaaattctcaaaacctttacgctgctcgcgcatggtttcgtaatcaagtccgccggtaagcgttaccggaaccgaaaacagggtatcacggtgcgtccagcgcgtatcaatgccctgatagtggcgagtcagggaaatcacgccgccgggatgcgacgggttgcgctgcacgctgacaggaatcgactggaactgcgtcgtttcacgcgtaccggcatacatcatcacactgaggtcatcgttttcactcatctggcgctgatagtgcaggccgccctgggtttgatcgacggttttgcgcgtattgaacagcgagacggtgctgacaacctgacggggattagcccgccattgttccggcgttaagccgcccgggtcctgcgcgtcgatatgaacgctgttgaacagtaacgtcagggtgctgacgtcatcgatgcgcacgcccagctttgcattaccgagatttttttgcgcggcactgtggtcgcgataaccgtgagtggtaaagcgcgaggcggaaatcgtgtagttaacgtcgccggcatgtgtgccatcgccggtggcaccgctggctttcacgctgttgcgccagctgccataactaccgaaccagctacccgcttcgagcgtcgggggttgctgtccggtttgggtgatgacgttaatcacgccgccggaggcgttgccatacagcgcagaaaacggcccacgcaatacctccacccgatcaatcgagccgatatcaatgttagacgtttgcccctgaccatccggcatggtggcaggaatgccatcaacataaatacgcaggccacgcaccccgtaagtggaacgggaaccaaagccgcgcagggacaactgcaggtcctgggcgtaattttgtcggttctggatctgcaatcctggtacgctggtcaggctttctgacaggttaacgcgcggcgcggcctggcgcatatcatcgccgttaaccacgctaacggcggcaggcgtatcaagttcgctcaggccttttgcggacggtgccgcgctgacgaccagcgtattatcgccgtctgctgcgaagagcggcagcgaagaaaatgtggcaggcaggactaaaaacggcaggctgacccgacgtaatcgcttaatattcatttgtatttggcctgaaagcgtggattccctgggtatgtcgcctgccagccagcggcttaaaaacacagcggttaacggcaggtcgcgaaactagtggtgctaaatgaaccaactggaacaatcgcggcatatattaatagttttgtcagttgtttggaaatcgtaaatgattgatcggtttatatgatcgtcatggcgttaaaacgtcatgcccttagcgcggttaaccccgtgatagcgcacgacgggcaggcaggcaggcaggcaggcgggcaagccagccagtaaggcaaaggccagcggacgtacagggtcacaggtgctacattttagcgtgcaccgccgggtaagcttaaggcggacaccactaatcaaaaataagggaatcagcatgaaacaacctgatgttgcagtactgggattaggcgccatggggcacgcctttgccgccaatttgctcaaaaaaggtttcagggtttacggctggaaccgtacccgcgcacggggcgaagatttgattgacgccgggctgacgttagccgcatccgccgcggacgcggtgcagcaggccgacgtcgtgattgcgatgttatcggacggtaacaccacagagcaggtgctgcatgaggcgaaagcggcgttaaaacagggcgcaaccctgtgccagatgggcaccatcggtgtggaaaaaaccgatgcgctgattgccttcttcgctcaggcgcgccccgatgtggtgtttattgacgcgccggtttccggcaccaaagcccccgcagaaaacgcccagattctggtgatggccagcggcgatcggtcccgtgctcaggcagcagaagccgtgttcggcgcgataggtaaaggaacgcagtggctgggtgaggcgggcaagagttcgcgcatgaagctggtcatcaacagctggctcattggtctgatgcagagtctggccgaaagtacccggctcgccgaccagtttggattttccaccgacgacctgtggcaggtgctggacggcggcccgctggccgtgccctatgccaaaatgaagctgggtatgatcgccagcgatgattataccccgcagatgcatctgcaatgggcgctcaaagacgcaaggctggcgctggacgcctctgagagttcactgcccgcactggaaaatatcgccagcgtctggcagcaggccgtggaagccgggcacggtgaagaggatttagcggtgatctacaagtatcttaaatcgcaatgagttcgacggtcagttttgatttcagcacccgcccgctggtgccgctggcgcacgattatccgcatggtgccacagaaccctggcaccatcacagctgcgcgcagcttattcatacgctgagcggcgtagtgcgggttgaaactgaactgggcagctggaccgtaccgcccagccgtggcgtctggctgcctgccttcacccgccacagcttacacatcaccggggcggtcgctgcgcgcacgctgtttatcgatccctttgccagagccgatcttcccgccagctgtcaggtcgtgcaaatttctgcgctgctgcgcgagctgattatcaacgccatcgatttgcctgtgtcctacgcgccagccagccgcaccgaacggatttatgaattgatcctggatgagatacgcagcatggacgtgctgccttttgccttgcccctgccacagagtccacgtttacaggcgctctgcctgcaggttcaggctgacctgtctggcgactggtcgctggcggcagccagcgccaggctcaacctgtctggtcgaacactggctcgccattttgtacgtgaaaccggcctgcagttcagcgactgggtacggcgagcccgcgtggctatcgccctgacgcggctggcacagggcgacagcgtattgcgcgtggctctggatctgggctatgaaagcccaagtgccttcagcgccatgtttcgccgtctgctgggcgtgtcaccaacggactactttcctgcggcagaaagtggctcgccgcgttaagcaatgcctgcagtgcggcgcgcgacgtatcattgtcgatgctgacgccccagtggcgttcaccctgaagattcatgcaactgacataggcgactgagcggctgtcgctgcgttttcccagcgtatgttcatgataatgttcaatggtcagcgccaggtccagcgtctgacgcagtgccgtaacggcggcggaaagcaggccattcccgctaccagtcagcggcacggtgcggtcgtgatgatggacgtgagcccgcaactgcgtctgctcgcccgactcgctttgactgtgtgcatccatcaggcgcagggcaggctgttcaatctgatagtgacggcaaaaaagttgccagacagcatgctgtgtcatttcttttccatgcagatcggtttcctgttgaacacaacggctgaaatcctgctgcagtgcgcggggaaggtgcaggccgtggttttgctccagcaaccaggccgcgccgcttttacctgactgactgtttacccggataacggcttcataactgcatccaatatcggcaggatcgagcggcaaataggggatctgccaccgcgtttcctggtgctggtggcgataagcgaatccctttttaatcgcatcctgatgagagccggaaaaagcggtaaaaaccagctcgcctgcatagggatgacggggatggaccggcagtttattgcagtcggtgaccacctcaatcacccgggccatatcgctaaaatccagtcccggcgcaatgccctgggtgtaaagatttaacgccaacgtgactaaatcgacattaccggtacgctcaccattgccaaacaggcagccttcaatgcgatcggcacccgccagcagagccagttccgcgcaggcaacgcccgtcccccggtcgttatgaggatgaacgctgatacacaccgcgtcacgtcggctaaagtggcggcagaaaaactctatctgatcggcgtaaacgttgggcgtgttaacttcaacggtggccggcaggttaatgatcattggccgttccgcgctgggttgccagacgtcggcgaccgcttcacaaatctccagcgcgaaggcgggctctgtaaaacagaaggtttccggcgagtactcaaagctccaatgtgtttcgggcgcggcctcacaggcggctcgaatctgttgtgcgcttgcggtcgccagcgccacgatctgttgtttactctgattaaacacgcgctcacgaaataagggggcggtggcgttgtacaaatgcacaatggcgcgcggtgccccttccagtgcgcagaaggtttttgcaatcaggtcctgacgcgcgggcgttaatacctgcagcgtcacatcatctggaattcgcttttgttcaatcaggtcgcgcacaaagtcaaaatcggtttgcgaggcggaaggaaaggcggcttcaatttctttgacaccgcagtccagcagcaactgccagaactgaagtttttgcgtgcggttcatcggttccgccagcgcctgatttccatcccgcaggtcagtagacagccagcgcggcgcacgggtgatctgttgtgaaggccactggcggccagccagatcaacggaggggaacgggcggtatttctcagccgggtgcatcaacatagtcatctccttgtaggtgtttaagccagtgtggcgtggcgagaagtctgtcgcgcgcggaaaactgacaacctgaagcgcaaaagtgacaaccttgttgacggcgtgtggcgctgcgtgcgcaggcgtttgctgaagtggaaagacagcggtagcataagccgatgtttcccaaggtggttttcctatgctggtttttgacgggcacaacgatctgttacttaatctgtggctgtaccatcgcgatgcgcccgcagaggcattctttgcgggcgtgccgaaaggccatctggacttttctcgtatgcagcagggcggttttgccggcgggttgtttgctctttttgtaccgccgcaggactaccttgctcaggtcgccccggcgcgtgcggcgcaagaagactatgagccactgacgattatgtggcagcaactggcgatactgcagcaaatagccgcgcagtccgacgggcgcgccaggctttgccactgcgccgcagagattgaagcctgccgcgctgaaggggttctggcgctggtggcgcatattgaaggcgctgacgccctggacgcagacggcgaaacgctgaacgccttttatcaggctggcgtccgctccatcgggccattctggaatctgaaaaaccgctttggagagggcgttaacggcagtttcccgggatcgccggacacaggaccagggctgacggcagagggggaaaggctgatcggccaggccgctgcgctaaacatgatgattgatgtttcgcatatgaatgaaaaagccttctgggatacggcccggctgtcagacgcgcccctggttgccagccactccaacgcccatgttctgtgcccacagccccgaaacctgacggatgaccagctcaaggctattcgcgcgagcggtggggtggtcggtattaattttggcaatgctttccttcgcgccgacggtaaacgtgacagcgacaccgatctggcagaaatcgtcaaacattgtgatcacttgattaacataatgggcgacaatcatgtggcgttcggatcggactttgacgggatttcgccgccggaagcgctgggcgacgtgagcggtctgccgcgattgctcgccgtttttcgcgactcgggctatgatcaaaacgtactggagaaattaacgtggggaaactggctgcgggttttgcaccaaacctggctgggttaacacgttttcttacgggcttttcattgatttcactgtgcggtctgcgagaaaatagtgtgacaaggttcgcatttcaatccctgtcacactgctgttttgcagtaatttatttgtctgtttatctataaggaagaaaattatgtggaaaaaaccaacgtttgttgatctgcgcctcggtctggaagtcacactgtacatctccaaccgctaatcatttgcccgccgtttgcgcgggcatttcgtttcaacacctggtccctttcatgtttattaaagtccttggatctgctgcaggcggtggatttccgcaatggaactgcaactgccccaactgccagggtgtgcgtaacggcaccctccaggccacgccgcgtactcagtcctcgatcatcgttagcgataacggggaagactgggttttatgcaatgcctctcctgacatcagccagcagattttgcacacgccagaactggttaaaaaaaacgtcctgcgcggtacagccatcggcggcataattcttaccgacagccagattgaccatactacgggcctgctcagcctgcgtgaaggctgcccacatcaggtgtggtgtacgcccgaagttcatgacgatctgaccaccggtttcccggtctttaccatgctcaaacactggaatggcggactgcagcatcggcccattcgtccgttaacgccgtttaacgtcgatgtttgttcggatctccagttcaccgccatcccgattctcagtaatgcgccgccatactcgccataccgcgatcgtccgctaccgggccacaacgtggcgttgtttattgaaaatcgcgctaacggtcagacactgctgtatgcgccaggccttggtgagccggatgcggtgatccttccctggctggagcgggccgattgcctgctgattgatgggacggtatggcaggacgatgagttactgaccgccggagtgggtaaaaataccggaaaagcgatggggcacctggcgctggccgacgagcaggggctgatggcattactcgcccggctgccggcaaaacgtaaaattttaattcacattaacaacaccaatcctgtccttaacgaacagtcacctcagcggcacttcctgtcacaacagggaatagaggtgagtcacgacgggatggcgatacatcttcaggactaaatcatgctgattacggaaaccctgtcgccgcaggcctttgaactggcgctgcgtgataaaggcgcgtactaccatattcatcacccttaccatattgcgatgcataacggccaggccacgcctgagcagattcagggctgggtggcgaaccgcttctattatcaaaccagtattccgctcaaagatgcagcgatcatggccaactgcccggacccggcgacccggcgtaaatgggtacagcgcatcctggatcacgatggcagccagggcgacgatggcggcattgaagcctggttacgcctgggcgaagcggtgggcctgagccgggatgagctggtctcggaacagcatgtcctgccgggcgtgcggtttgcggttgatgcctacctcaactttgcgcgtcgcgctaactggcaggaagccgcctgcagttcccttaccgaactctttgctccccagattcatcagtcgcggctcgacagctggcctcagcactatccgtggatcaaagaagagggctatttctatttccgcagccgcctgagtcaggcgaaccgcgacgttgaacacggccttgcgctggcgctggcattttgtgataccgctgaaaaacagaaccgcatgctggagattctgcagttcaagctggatattctgtggacgatgctggatgccatgacaatggcttacgaactcaaacgcccgccttatcatagcgttacggataaggcagcctggcacacaacccgactggtataacgatgaacgaacacgcaattgccgcttttcgccgtggctaccgtatgcaatgggaagcagctcaggacagtcacgtcgtgctctatccagaaggcatggcgaaactcaatgaaacggccgccgccattctggcgctggtggacggcaaacaggatattgccgccatcattgccatcctggatgcccgttttcccgaagcaggcggcgtcggcgaggatgttaaagaattcctgcagtcagcgtatgaacaaaagtggatacagtttcgtgacccagcataaacccggcgtgaacccaccgctctggctgctggcagaactgacctaccgctgcccgctccagtgcccgtactgctcgaatccgctggattttgcccagcaggaaaaagagctgagcaccgagcagtggattgaggtgttccgccaggcacgtgctatgggcagcgtgcagctcggcttttcaggcggtgagccgctgacgcggaaagacctgcccgaactgatcaaagcggcgcgcgatttaggtttttataccaacctcattacctccggaatcggcctgacggagaaaaagctggaggcattcagcgacgccgggctggatcatattcagatcagttttcaggccagtgatgaaaccctgaacgcagcactggccggttcgaaaaaggcgtttcagcagaagctggacatggcgcgcgcggtcaaagcccatggttatcccatggtgctgaatttcgtcctgcaccgtcacaatattgaccagatcgataagatcatcgatctctgtatcgagctggaagccgatgacgtggagctggcgacctgtcagttttacggctgggcgcagttaaaccgcgagggcctgctgccaacccgtgagcagattgcccgggccgaaggcatcgttaaccagtaccgtgaacgcatgagcgacagcggtaatctgaccaatctgctgtttgttacccccgattactatgaagaacgtcccaagccgtgcatgggcggatggggcgctatcttcctgagcgtcacgccggaaggcacggcactcccgtgccacagcgcacggcagctgccggtggcttttccctctgtgcttgagcagagcctggaagatatctggtaccactcgtttggctttaaccgctatcggggctttgactggatgccggagccttgtcgctcttgtgatgaaaaagagaaagattttggcggctgtcgctgccaggcctttatgcttaccggcgatgcagacaatgccgatccggtgtgcagtaaatccccgcaccacggtaaaattcttgatgcacgccgtgaagctgactgtagcgacatcaaaatcggccagctacagttccgcaatcgcagcaactctcagctgatttataaaacgcggattctgtaatgcacacacgttgcctgcaactcaacggactgaaggtgacgctgatccaccagccggaggccagtcagtcagcggcactggtgagcgtcgcggcaggcagccatgatgagccggatagctggcccggcctggcgcatttgcttgagcacctgctttttaccggcagtcagcgctggccaaatgacgggcggttgatgagttgggttcaggcctgcggggggcaggtgaatgccagcacccaggcccgccagagcgcgtacttttttgaagtcgcgcctgagaattttagcgaaggcctgctgcgcctgcaggatatgctgagtgcgccacgattaacccttgaggctatccgccaggagattggcgttattgatgcggaataccggctgctgcagcatcatgctccggcgcgggcggaagccgctatcttcacgccggtgacgttccccgccgtatttcagcgcttccagacgggcaacagggcagcgtttggtgacaacgtcacagaattgcacgcggcgttgcaggcctttcatcagcgtttttatcaccctgagaatatggcgttgtggctccaggggccgcagtctctggaagcgctcaccggtctggcagaaacctttaccgccgcattttccccacgtccattgcagctgcgcaagcgtgccagcatcaccccgcaaccggttcagctgtcccccgaccggagcctggccttacagcaggaagggccgtccgcgctgtggcaaagctggctgttacctgccgcatttcgtgacagtgtcactctggtgcgggaatttttacttgatgacgcgccgggtggcttactggccacgctccatgcacgcagcatcgcgaccggcctgcaggtgaaatggctttatcgatctgacacgaccgactggctggcgataacggtcgccagcgagcagcctgcgcctgtgatggcactgctgaatgcgtttctgcaggcgttaagtcttaccagcacggcgcaacggcaacattactggcagctggcacagcaacggctggctgcgcaatcgccactgatgcaactgcaggcgcgtgcactgggctttgcggccgtgggtgaatgtcctgatatctctgccttattaagcgaattgtccacccgtgccgcgaccacgcttttttgtaccgccgatgcgcaggctgaaaagcgccttatacagggctatgaactcgcgctggcaacctggcaggtgccagcgtaccgttgcccgaccgttaactggtcattttacccgcagcaaagtcctttcccactcagtgatgcgcccacggatgtggcggttctgccgcacatcgcgccggatacgtcgccgggtacgctggtgctgcgccccgagctgtttaccacgctggcggcgggcccggcatatgaccatgccttacggcccgtctttgcggtgttacgccattttgccgctagcggcgagtggcgcgacgttcagggcgtctggcaactcaggctgcagctgccgtcagacaagacactgctcagcgcggcgctggcgcagcttctgcaacgcctgagccagccagccagggcatcctcaccacacataccgggcattgcgatacgcgagctgctgcggcaactgccttaccaactggctacctctgtggagcctgcaggctggcgtgctgtcctgttgggcggtgatgctgaccagcagcggatcgtggcgcagcaactcagtgtgcttaaggtgaattccccgacgcgtccgtctcccgcatcggttgccggtgaaacctgtatcccccaggcgacggatgacagtgctgttttgctgtttattcccctggacgacgggcagcaactggcagcgcttcgtgctctggcgctgatctgtgagccgcgtttttaccagcgctatcgcgttgagcagccggtaggttatgtggtcagctgccgctaccatcgcagtgtggacaccgatggccttctttttggcttacagtcgccggattgtccggcatcaacattgattcagttctgtgaagccttcctgcatgacatgacccctggcgttgcacaatgtgatatcaacccgatcaaaactcagctcatggggatgaaagaagaccccgaggtggcagccctgcgtcaggcgaacggcctgaccaaccttgagcctgaaaaggtcgcctcactgactcaggaagcggtgcaacagctgcatcaacgattgttaacctgccgacaccgctggcgcattctctacactaaaggtaagaattaaaataatcactcagtgatattgctgaataaatttgattgtttacgccaaatctcttcactttttattcgcgtgtatatgccccaaactcagatggacgccataaaataaggaatagaaagtgaagaatgtaaaacgtttaactctgccactgctcgcggctgctgcgctgtatgtccctgcttctcaggcagaagccatgcattatcaactcgacccacagcatacgtctgtagtgatgagctgggagcacttcggcttttcgcatcctaccgctgatattccagatgctacaggttccctggtgtttgacagcagcaaacctgagcagtcgcgtgtcgacgttaccctgccggtaagtaaaattgacagccatgtcgctgccctgaccaaagaattcaaaggtgcggactatttcgacgttgcgaaataccccagcgccaccttccgcagcactaaagtcatcgccaaaggcgataacaagtttgatgtggaagggaacctcaccctgaaaggtattaccaaacctgtcacactgcacgccacgctgaacaagcagggcgagcatccgatggtgaagaagcaggcgattggttttgatgccaccggcaccatcaaacgttcagacttcaaactggacaagtacgtgccagcggtcagtgatgacgtgaaactgacgctctctaccgaagcgtacgcgaagtaattctgcgtttgcgttctcagcccggcactcaggtgccgggtttttttttgcctggcctggctacgggcaacccggcaaacaggcagcgtctgcattcagcgttgtcaggccctgaacgagtcggcggcgaccgaaaccggctcaaaaagcgccagcattgtctgaaaaaaaaagcacttcatcacgttattttcggcggctgaaaaagcctgagcccgtcccgcgtaaaattaatcctctgccgtacctaaaaaaatgaggcgaaaatcacaaatttgcatcgtgattttatcgacgcctgcgcgatataacgttgacagaaaagcgaggggcatcgttatatttaacttgttgttttaaaaggataagctcacaacccccctttgcgattaaaatgtgatttctttcacataaataagccatccgtacgcgctgtcaatacatcacctaaataaattcctctcatttttgtgatcttaattgcaaatatcagtctgttatcccgaaacaatagcgtcagacgcattaagccagaaggaagtcaggatgagaatcggaatggtaattagcggcggtgacgtaaccggcattaataatttcattttccaggtgggcagaatgacccaggcggaaatggtgttatttaatggcggtattcctggactgctggataatgtctgtcaggaaatatcgcagcgtgatttactggatttttccatcacgtccattccggtgatgcagtcgggcagaactgcgcgaaaattaattcgcagcgaatatgaaaccattgcccggcagttaaaaacattacgcattgatgtattaattctggctggcggtgacgggtcgctgcaatttttgcacacgctgagtgaatttggcgtcaactgttttggcatcggaatgaccattgataacgatgtctacggcagtgattacaccgtgggtttttccaccgcctgtgagcaggttttaaaagaggtggcaaagctgagaaacaccggtcgggccttaaccgggcgtgtgtttatggtagaactgctcggcggttattgtggtgagctgacgctacagtccgccataaaatccaatgccgattttgcgctgatcccggaatgccagattcccactagcgtgctggcagaacgcatcactcagcggctcagcgaacagaacagcgtggtaatcctctgttcagaaggttacacacgagaatattcaccgggatttcagggcgcgattgatacattaatcaagcaacttgaaccgttgatcggcgtgcgtattcgcaaaacgatcgtcggctatggactgcgtaatggcgaccccacctgtgaggagatttatcagggcaccattatggcaagtgaagtcgtccgttgtattcaatccggaatgcgtaataaagccgtcattattaatggcagcaataagcctattccgattgacttaataagcatgaaaaaacgcctggtcgatacagaagggcaccattataaactcgctaaacaactgcatatattgtgaggagaaaacatgctgaaaattttatgtgtctgtggttgcggtctgggatcaagtttcgctatcgaaatgagtgcgaaatcagttttaaaaaaactggagattgaagccgatatcgatcacaccacgatttcagaagctaacgcatttaaatccgacatgattttaacgcaaaaagcctttgcggatgtcttaaatgccgacgccacaccagagcaaattaaacgcgtaattatattaaataaactcaccgataaagctgaaattgagcaaaagatcgtggctttcttaaaagaacgtaatgtgaaggttgctaatcatgaatagtgtaatcaattttctggttaaagacttattggggcaggcgtctattctgatcgcgtttattgcgctaatcggactggtcctgcaaaaaaaatcggccgggaaggtcgtggaagggacctttaaaacccttctgggcttcttgatcatgatggcgggcatcaacattattgtgggtgcgcttaccttccttaacagcatttttacccacggtttcggcatgcagggctacatcactgacgtggccgcgattgccgggctggcaaaccgtgagctgggctcggaagtggccatgacgctactggtgatctttatcgtcaatatcatcattgcgcgcctgacaccgttcaaatacatcttcctcaccggccaggcgctgttgtggatggcaaccatcggggccgtgatcggttacaaagccggtctgaccggattaccgttaattctgaccggcggtattttcggcggcattatggcggtggtgatgccggcactggcacagccggtggtgcgtcgtatcacggactcggatgacgtcgcgctcggccacttctgcactatcggttatctgctcacggcggcggtggcgaaagtcgtcggccgaggctcacgctcaacggaagatttaaagctccccgataactttaagtttttgcaggacacctatctgtcgatggcggtggtcatggtgccgatgtacctgattcccgctgtggcggcaggtccagcctttatcgcccagtacagcagtggtaccaactacctgatgtatgcctttatgcagtctatccagtttgtggcgggcgtctttgttttatacagcggcgtgagactgctgctgaatgaactggtcccggccttccgcggcattgcgatgcgactggtgccggatgccaaacctgcactcgactgcccggtcatgttcccttatgcgcctaacgcggtcatcgtcggctttcttgcgaccacgctcggctctgttgtgggcatgctggtcttcccaatgtttggtctggcgatgattctgcccggcttgctgaccaacttttttgccggcggtacagcaggcgtatttggtaacgcactgggtggacggcgcggggcaatgattggtggattcgtccacggattatttattaccttcctgcccgccattctggtaccgatgctggaaagctacggctttaccggcgtgaccttcagtgattccgacgtgatcagtaccggtctggttctgggacatgctttccagcataactggctgtttgtcgccgtattcgttgcttttgttaccgctatcgcctggtttgttaacggaaaatccactaagccccgtgaggaaaacgtgcatgaaactttataactttaccgaattactgaaaattgccaaagaacgtgaatttaaagcggtagggtcgtttaatttacactgtcttgagatgttgccggcgttttttaaagcggcagaaaatacgcacagtccactgatgattcaaatatcaaccgggaccgcgaaatatcttgggcacgaattattggttgatgccattaagtcattatccaaaagtaaaaatattccgacctgtctgcatctggatcactgttccgatttagactcgattcagacggcaattaatgccggattcagttcggtgatgtatgacggttcacatttatcgctggaagagaatatcgcgaatacccgcagggtgattgatatggctcgtcccgtgaatgtttccgtcgaggctgagctgggtgctatcggcggttctgaagacggaaaatgtgtggaaatgagcgatatcgtgtttaccacggtcgaggatgcgaaacgctttgtggatgaaaccggcgtggacatgctggccatctccatcggtaccgttcacggcctttataccggtaaagcccacatccagcatcaacgcctggcggagatcacggctgccacgggaacgccgctggtcctgcatggcggaaccggggtcagcgatgaggacatgcgcctggccgtgggcagcggtatcgaaaaagttaacgtaggcacggaaatgaatgtgcagtgggttgcccagtgcaaagcgacctttgagaaaggcaaagtcaatgacagcgtgcgtaatttcctcgtacctgccaataatgccgtcaccaatgtattagttgagaaaatgcagctgttccgttaagcacttttattatcccgacgtgaataaacctgaggtgccctggcgcttttcggggcaggagacgctatgtttggattcatgaaaaagaaagggggaaataatgccccagatgatgcagaacgggatcgtcaggcagaaagtgtcagtgaaaaaataactgcgctggaagcgaaactggcgattaattcaggcgatattgaaacgcagaaacaattaatgctggaatataatcgtgcattatccctgtttgcgaaaagccgccgttaccgggatgacattgatcctctttttgtgaaaattgatgaattacgtaatctggtgcgtaaatcagtttaaggagcagtaatgaccattaaacagttattacaggaagccaatgctgttcaggtaggcattgccgccagggactggcggcaggtgattgccatggcggcaaaaccgctggtggagggcggttatgttcatgcctcttatcctcaggcggtcattgataatacgctgacgcatggtgcctattacgtgtttgaagaaggtatcgctattccccatgcccgcccggaaacgggcgttatccgcgactgcttcagcatggtattgctggcggaacccatctcgtttgagggaagcgataaggcggatattgtgatcatgtttggtgcccgcgacagtaatgcgcacatagaagagggcattcgcgccattgtcagtatgcttgaggatgaagagacgctggtaaaattacggcgtgccagcagcgttgcggaagtaatggagatcctatgaccagtgagactgacataaagcgcgtggtgttagttaacgggattcctgcctccgggaaaagcacgctggcccgcacgttgtcacagcgcttttccttgccggtgttaacgctggacagcctgaaggagccgtttatgtccagctttgcgccggtcgatcgccagcgcaaccgacagctgggctgtgcggcttatcaggctatctggaatatcatcggccagtcgcccagcgactgcgtattcctgattgatgcctggtttggctttcagcctaaaacggtactggagcagggattacagcgggctggcgtgaatgacgtgctggaggtgtggatgcagatctcaccggacgccgccgtggcacgctaccaggcgcggctgacgcaacgcatgccgggtcatcccggtgctgagtaccttcctgagttgcgtcgtctggctgaggaagcgcagccgatggcactggggccgctgttaaaggtcaatgccagtgctatcgacgagcacgccgtgatccagtggctggctcagtctctgggccgggcaggctatactgcttctgatgaggataataccgaggagaagcagcatgccacagccgccttatctgcaaacgggcgagagcgtcgtgctttatgatggcgtttgcaaactctgtacaggctgggtgagtttcctgctgcgccaccaactggcgcagcaggtccgttttgctgcggtgcaaagtgagcagggcaaagcgctgctgaagtgggcggggttgccggaggacaatatcaataccatcgtctatatccgtggcgatcggcactggctgcgggcacaggcggtgctgcgtgtgatgcagcagctaccgatgccgtggcgggcgctgagcgtgctgcgctggtttcccccgcgcatcagtaattttttttacgactgtattgcgctaaaccgctacaggtggtttggccgccacccggctcaacaggctattcaggcagattatccgggccgctttctgccgccacatccctaaccgcaacgcggttgcagtaaaaaacaccacgaatgtgaattaaaaccttcattttccttcaggtttactaatattttacaggcaggtttaccgcgcgatggaaacgtaatgcgctgtgcctgagcggtattattattgaaaatggagatgaaaatgcgcaatacctctggacgatcggccgttgccgtgacgctttatgctcttctggaacccgtgccgcttggcttttttgtggcagcctggttgttcgacatcatctatatgaagacctatatcattctctggtcaatcagtgccagctggctgattgccatcggcctggtgatggcaatcctgccccgagtaattagtctggtttatatgtttcgcggcagtaccgcacccgagaaaacccatttctggctctccctggttgccgttcttctggctatcgccaatgcctttattcacagccgtgatgcttatgccgtggtgccgacggcggctgtgctgtcgacgctggtcgtgatactgctgctgctggcgaatgtgcaacttgcactgcgtcaacgtactgcttaaggagaagccataatgaaaatgccgcaacattcccttattgcgctgacgatgatggccctgctgacgggttgtgataccggtgcgacaatcgatccgcaaaagcaaacgggtgccaatcccgaattacccgacgccaaaaactttatggtaccgccaatgcaggtgcctaaaggcgtgccgtggaagaacggcgaaaaacctacggtggcgcagggcctgaagattgagaagattgctgaccatcttcagcatccgcgtcaggtttatgtgctgcccaataacgatattctgattgccgaatccaacggcatgcccaaacccacgacgaaacccaaagagttaatcaccggtctggtgaaaaatgcctcggggaaaggtggtaagggcggcaaccgcattaccctgctgcgtaacgttaacggaaaatgggaacagcaccgctttattgacaacctgagcgccccgtttggtatgcagctggtgggtaacaccttgtatgtcgccaacgcagacagcctggtgaaattcccttataccgaaggacaaaccgaaattcggaccgctccgcaacgggttaccgagttacctggtggcccgatcaaccaccactggaccaaagcgctgctcgccagtccggacggcagtaaactctatgttggcgtgggttccaacagcaacattaccgagaacggcatcggcgcagaatatcgccgcgccgccattctggaagtggatgccgccagcggtgccagtcgtatctacgccagcggtttgcgtaatcccaccggtcttggctgggaaccccagacgaagcagctgtgggcggtgattaacgagcgtgacgaaattggttcggacctcgtgcctgattacctgacctccgtgaaagagaacggcttctatggctggccctacagctattttggtcaacatgtggatgtacgggcacagccgcagcgtccagacctggtcgaaaaagcgatcaagcctgactatgcactaagctcgcatgtcgccccgctgggattgctgttctatggcgcggagaatatgccacagtatcgcggcggcgcatttatcagcgagcacgggagctggaaccgtaaaccgcttaacggctacaaagtggtttgggtgaagttcgagaacggaaaaccggtggggcaaccgcaaaccgtggtatcgggctttttaaccgaagatgaaaaagaggtgcgcggcttaccggtcggcctggccagtgacaaacagggcggtttgatcatcgcagatgatgcgggtgattccatctggcgcgtcagttcggcgaactaagcggtaaatagcaggcataaaaaaaggatttggcgtgatgccaaatccttttttcttgtgttcgttgcccggcgggtaaccggatggcgaacgaggtgctcagcactctccacaaacagattgtaaagagtgccgccgcagacttcaagtttagtgaaaatgctgtatatttatacagttgttgagtgttgggcatcgcctcatggttaactgactgcttccaggggagcacggttacataaatcccggcaggtaacaggtggtgctgacctgtggcttaaaccatgagtgccgctcagccctctccacaaagatgtgctcaggcacccggcgggtaagggtaaagccccggctgctgaacagcgcgctcctgttgtgggagaaggaaagtgatggaactgacaaagctgattctggagattatccggatcatcttgcagatcatcgttgcccttatgcaactgaccggtcatgcaaactaaccggaactttgaccaaggcggagctaaccactccgcctttttcgttgtcaattgcctgtcatctttcccggctacagtggcgcggcaatcaggcgcccgaaaggcacgacttatccagacatcagaccagatccgggagtttttcatgtcacttgccgcagtcaaacccgccaggcttcagcagaccgaaattgacaccagcgtacgtatgcgtgaaaccgaggttggggcgcagtgtgaaattttggcgcacagttaccttgagtacagcgccattggcgatttctcttacgtcggcgagcactgctgcatagccgataccgaaataggccgcttcaccgccatcgccaatcaggtgcgtattggcgcgcccaaccatcctatggatcgggcatcacaacaccgctttacctattgcccagagtattatgatgctgccgcgacgcgcgaccacggttttttcacggcgcgccgtgaggaccgggtagtgattggcaacgacgtctggataggccatggcgtgattgtgctgccgggcgtgacggttggcgatggggcggtcctggcggcgggtgcggtggtgacgaaagacgttgcgccttataccgtggtcggcggtgtgccagcaaaaccgattcgcgttcgctttcatccggccattgcaagccggttacagcacattgcatggtggaactggccgctggaaaaaatcatggcaaacctggccgattttcagtcagacgacattgagcagttttgtgccagacatggctgagaacgtcagaaaagccaataaacggtggcgaacgccaccgtttggcgtgcgggttagcgcttagcgcgcgcttcctgcaccttgctggcgatacggtcgccgatggtttgatcgatattgcgccagtaggcaaaggcacgtgaaagcaccggttcttcaacgccgttcagcagatgcccgctgacattattcaccagcctgtcgcgcgcggcgtcatccatcaccttgttgattaaggtatttgcctggccgacgtcgtcatcgtcccgacgcaaagtgtaaggcgcacgcaccatatcaccgctggcagaccagacagagtcggtgggataacgatcgccatcggcggcggggccacctttgctgttaggtgcataaaccggatcggacaccgggttcatgcgcatcgcgccatctttgctgtagctgttcaccggcgactgcggggcattaaccggaatctgcttatagttcaccccaagtcgtgcgcggtgggcgtcggcataggcaaacacgcgaccgagaagcatcttgtccgggctgagtccaatgccaggcaccagattattgggctcgaaagcggcctgttcaatctgcgcatggttatcggtcgggttccggttgagcgtcagcttgccgactttgattagcggataatcactgtgcggccagaccttggtcaaatcgaaagggttgtaacgatagtggtcagcgtcggcaaacggcatgatctgcatgtacaacgtccagctcgggaaatggccgtttttgatagacatgaacaggtcacgcgtgtggtaatcgccatcttcccctgccagcttgtcggcttcttcctgcgtcaggttttcaatgccctgatcggtatggaagtggtatttcacccagaacttctcaccctggtcattcacccacatataggtgtggctggagtaaccattcatatgacgccagtttttagggataccgcgatcgcccatcagccaggtgacctggtgtgatgattcgggtgacagggtccagaaatcccactgcatgtcgttgtcacgcagattgttatcggcgcggcgcttttgcgagcggataaaatgctggaacttcatgggatcgcgaataaagaacaccggtgtattgttgcccaccatgtcgtaattgccttcgctggtataaaacttaatggaaaatccgcgcggatcgcgccaggtatccggactgccgcgctcgccagccaccgttgaaaaacgcatcacgacgtcggttttcgtgcccggctgaaagactttggctttggtgtagcgactcacatcttcagtcacctcaaaaaagccaaacgcgccgcttcctttcgcatggggctgccgctcaggaatacgctcgcggttgaagttggccatttgttcaatcaggtagtggtcgtgaagcaccagcggaccgtcgggaccgacggaaagggagtgttcatcactggcgacgggaataccagcgtctgttgtggtgggtttacgctcatcatgactcattgaaattgtctccatttttgtaagggtaatgcatggagtaagcgtagcgtaaatctggacacagcaatggccgatcccgcgccgatgtgcatttttacggcgcctgcccgtttctgacgccttcccgcacctgtccccgcaacgccttgctgacgcagaggttgtgtctttttgactgatcaccgcaggttgttgcctgaggtgattaatacgtgaccgccctcgcaatttacttatttcccccacaacaacggttgcgcgttatcgcgtaaagagtaaattctattataacttcacatttagttgtgaaaaaggaaagtacattacaaccctgttactaaggattgagcctcatgtcagatttaaagtttgctacacgtcttaactcattcgcttcaggggcacatctctactggccggatttgcagggcaaaccctctgtactgcaaatggttgcgcgcgcgggcaaggttaaaggcttaacgcatttggatctcaactatccccagcacctgaccagtgatgtgaaaaccctgcgtcaggctatcgacgacgccggcctgtcggtcaacggcatgcagatgcgctgggatgcaccgcagttcaaaatcggtgcgtttacgcatcccgacgcaaagattcgccgtgaggcgattgatctgaccaagcgcggcatcgataccggccgcgagtttggctcccggttaatgacgttatggatggggcaggacggtttcgactactgcttccaggtcgattacaaaaaaatctgggaggacgcggtgagtgcggtgcgtgaaatcgccgactatgcgccggacgtggatgtgagcattgaatacaaacccaatgagcctcgcgcctacagcatctttcctaacgtaacaacctgcctgctggccgtagaagaagccggtagccctaatctgggcatcacgctggattttgcccatgtcctgttcgccaatgaaattcctgcctgggcggcggccatggtggcacgtcgttcaaggctgctggggctggatttgaatgacggctggggcaaacgggatgacgggctgatggcggcatcggttaatccgcgcgccacgctggagtttctgtggcagatgcagcgcgatggttatcagggtgcctactattttgacaccttcccggatgccagcgggctggacccggtgcgcgaagcagaaatcaacatcgccaccgtgacgcgattactcaagctttgcgaccagcttaacgataatcccgcattgatggaggcgataagccgtcaggacgccgtcgcctcacagcaaatcgtcaacgacattatgctggcgcgttaatgcagggcgtcagctgcagaacagcaaaatcttaccctacaaatgcataataaaaggctgaaaaaatgaaaaaacgtttactcgccgtcatcgcttcctcgctgctgtgcgccagtgtctatgccgcagagatggcgccgctcaagtccgataccgaacaggatcgcaccgaatggtcgcagctcgacagtaaatatggcgcgatgcccaagatcgataaatcgctcaaaatcggtggtgtctctaaaaccctgaccaatgaatactggcgtttgctgggcgagggttatcagaacgccgctaaaaaatatggcatcaccgtggcttatcaggccgcagcgaatgaagacgatcaactggggcagctgtcgattgccgaaaccatgatttcccagggctataacggcctgctggtttccccgcaaaccgacattaaccttgagcctgcactggaaagcgccaacagtaaaaaaatcccggtagtgaacgttaacgatgcggtgatgccagatgccgaacattacgtcggtaacgtccagaaagacaacggtgtgcgggtggcgaaatggtttatcgagcaccatccgcagggcggcaaagttgcggtgattgaagggcagcctggcgtctatgctgccggacagcgcaccagaggatttaaagaaacgctgaaggccaacggcaagttcaatgtggtggccagcgtaccggccaactggagccgtgagcaggcatttaacgccgccagtactattctgcaacagcatcctgacctgatcggcttttacgccaataacgacaccatggcattgggtgtcgtggaagcggtgcgttcgatggacaaagccaaacaggtagccgtatttggtactgacgggatctccgatgcctatgcgtccatcaagcgcggcgaactgaccggtaccgtggacagcttcccggtgctgacgggtgaagtggcgatggatgtgatgctgcgtttgattaacggccagaaaatctcacgcgtggtttccaccccgcaggcgctgatcaccaaagagaatgcggatgcattttccaccaaagacatggacaagctgcgtcaacttttagcgcaacagtaagcctggcggagagcgtatggaacagtatcgtttaatgatgcgcggcatcaacaaaacctacggcagcgccgcagctttacagaatgtcgacttttttgtgaagcccggtgaagtgcatgccctgattggtgagaatggcgcggggaaatccacgctgttgaatattctttccggtgtgcggggcgcagacagtggagaaatcagcgtcaacggtaagacggtgcagatgaaaagcccactcagcgcccgtcatgcggggattgcgatgatccaccaggaactgcaacacgttccagagctctcggttgcgcagaatatgttcctgggccgcccactgaccaaagcaaaagggtggtgggtggataaaaaagcccagctgtcgcgcgccacgctgattttgaaacggcttgatcccacgatcgatcccaacagcccgatcaaagatcttaaagtgtctcagcagcagatcgtcgaaattgcccgtgcgttactggatgacgctaaaatcatcgccatggatgagccgacatccagcctgacgccgcgcgaatttgaccggctggctgaactgattgccgatctcaagtcgctgggtgtgtccttgatctatgtgtcacacaagatgaacgagattttccgggtctgcgaccgggcgaccatcatgcgcgatggtaaacaggtcggggtggtgaatatctgtgacgaagatgaagagagcatcgtcgccaaaatggtcggccgtaagatagaaaggctcgatcacaacgccttcgtgaccgcacaggaagtgttgcgggtcgaaaatctggcgcgtggcaacgaaatattacccgctaattttagcgtcaacgccggggaagtgttgggcattgccgggttggtcggggcaggacgcaccgagttgctcaagctgattgccggtattgacaagcgcagcagcggcacggtgcaggtcaatggtcagcccgtcccgaatcataatatcagcgcggccataaaagccggaatcggtctggtaccggaagaccggaaaaaagagggcattattaaagcgcgctcggtgaagatgaatatggcgctgccgtccatgcgtcagttcaccctggcgggtgtgataaataaagtccggttaaatcgggtggcgcacgatgtcatgagcgaccttaaacttcgccctatggatattgaaaaaaccatcggtacgctgagtggcggaaatcaacaaaaagtcattatcggacgctgggtcgcagcggatgccaaggtctttttatttgatgaacccacgcgcggcattgatattggtgccaaatccgaaatttataatctgattgaacgactggcgcaggcaggtaaagccattattgttgtctcgtcagagatgacagaaattattcgcatctccgatcgcgtattagtgatgcgggaaggaaaaataacgaaagagttaaagggcgaggcgattaccgaagacaatattgcccgctttgcgattaaagatgtcgaaactgcctgagcgaacacctctctataaaggttatcactatgacgactgaaacaaatatgcagccggttggccgtgcatcaccgctgttgaaatttaacctgcgcgatgccggaaccttaattggcttactgattattgtggtgacattctctttcctgtcgccggtattttttaccgtcccgaatctgttgaatattttgcagcaatcttcgattaatgccttaattgctctgggcatgacgctggtgattatttcaggcggtattgatttatcggtcgggccaaccgccgcactgtctgccgtgtttggcgcaacgctcatggtctctggcgtgcctgtgcctctggcgattatcgccacgctgggcattggcgcactgagcggtattttcagcggtacgcttatcgcctatgccgggctgcaaccctttatcgtgacgctgggcggcttgtcgctgtttcgtgccatcgcgctgatctacaccggcggcaatccggtctttggtattccgatgtcgttccgcagcctgattaacagcacggtgttcggtgtgccaacgcccatcgtcgtggtggccgtgattgccctctgcctgtggacggtaatgaacaaaaccccgttgggtgagtacattctggcgattggcggcaatgaagaggcggcccgcgtggccggtgtgccggtcaaacgaaccaaagtcacggtgtacgtgatctcaggcatgctggcctctctggcatcgctgattctgattggccgcctgggcgcggcggaaccgaccatcggcaacctgtgggagctggacgccatcgccgctgcggccattggcggcgcgtcattaatgggcggcaaaggcagtatctttggcaccctgattggggtgattattttgggggcgctgcgtaacggtctgaccttgcttaatattcaggcgttttatcaattgctcgctacgggtcttattattatcatagcgatgttgattgaccgagcgacccgaggcaagtaatgaagcaagatccgcgagccattggcgctcagatacgtatgcgattacctcaactgacgccgttagaacggcgggttattgaggcaatcactgccagaaccgatattaccgaacaaacgtcgttaaaagagatcgcgcaggaaaacggtgtatcggaagcaatggtggttaagatcacgaaaaagcttaacttcacaggattcagaaatttcagaagcagtttaatttattataacgcctctgaagtggcaggtttgcatgcggaaattgagcccgatgattcatcggaacagttactggcgaaagtattcagaacctcaattcaggccattgaagaaaccctgtcggttttagatgtctctgaatttaaccgtgcggcagagattatttttaaggctcgtcatatcgatctttatgccgtgggcggatcggcaacggttgcgcgcgatctttcccacaagatgcttaagattgggattaaatccaccgcttatgatgatgcccatataatgctgatgtctgcggcagtgttatctgatgatgatgtggttatcgccatcagtcactccggtgccacgcgtgctgtgaacgatccggttaaattagccgcccgtaacggtgccagagtgattgtgattacgaattacgccgagtcgcctattgcgcgtcatgcgcatgtggtacttaattcaacttctcagggatcgcatctgttaggtgaaaatgccgcatcacgaattgcccagttaaatatactggatgcgctgttcgtggctatcgcgaaaaaggatttaaagcgggcggagaaaaacctgatcaaaacccagcatgcggttcaggatctgcgggaattctgagcatgagtaaaattgcagtcaccggcagtcttcattacgacattatgctggatgcccatcatcggcctgaaaagggcgaaacggtaatgggaaacgcctgccactataagtttggtggcaaaggcggtaaccaggcgatagcggcagccaacgctggcgcagatgtacgttttatcggggccgtaggggccgatgaacagggcgcgtttttactgaatacgctgcgtcaggccggggttaacaccgattcggtcgcaacgattaaggatgtcccgtctggcatgagcgtggcgattaccgacgcggaaggcgactatggcgcggtggtggtatccaatgccaatcagtacatagcggcggagccgttcatgcaggccggtttctggcaggatgtgtcgatgctggtgctgcaaaatgaagtgccggaagcggtgaatctggcggcggcgcaggctgcgcggcagcagcgtattccggtatgtataaatgccgccccggctcgccagctctctgccgaatttgaacgctgcgtcgatttgctggtggtgaatgcggttgaagcccgtgatatgagcggcgtagcggtgaccgatctgctgtcagccagacaggcggcagagcagctggcatcacgtttcagtcgtgttgtggtcacggcaggggaacatggcgtggctttcagcgaagccggcgaaacgcacagcctgcctgcccgtcagattacgctggtcagcacgcacggcgcgggtgactgctttatgggcgtcttgtgcaaggcgcttaatgatggccatgaccttgcgcacgcggtagcaaccgccaacgatgctgcggcagagcacgtctcacgcccgatcagataaaaaaatgcaacgtcagggacgttgcatttttacaggatcggctggattacgaggcgactttaaccacggtttttccgaagtttttgccgttcagcatatcgataaaggctttgggggcctgttcaaggccctcaatcacgtgttcgcgatactgaatttttttgctctcaaccaacggcgtcatggctttcaggaattcgggataacgatggccgtaatcctggaaaataatgaaaccctgcatacgaatgcgacgtttcaggatgcccgccataatcagcgaggttctgtccggaccggcagggagtgctttctggctgtaggcggaaaccagaccgcagactggcacgcgcgcggcggtatttaacagcgggaagacggcgtcgaacactttgccaccgacgttttcgaaatagatatcgatgccgtccggacaggcgtttttaagctgttcttcaaagtccgggctgtgatgattgatacaggcatcgaaccccagattttctacagcatgacggcatttttcctcgccgcccgccacgcccaccacgcgacagcctttcattttacctaactgacccacagtggcacccaccggaccggttgcagcggcgaccacgagggtttcaccttctttcggctgaccgatgtccattaatcccatataggcggtaaaaccgggcatgcccagaatacccagcgcccaggaaggatggggcagattgttatccagacgggcaacatctttgccatcagaaaccgcatattcctgccagccactttggcaaagtacccagtcgccctctttaaactcactgtttttggatgcagcgacctgacagaccgtaccgccgaccatcggttgatccagctcagccggtggcgcgtacgattttccctcatccatgcgtccacgcatgtaagggtccagtgacagataaatcgtccgcagtaagatctcgccgtctttaatctccggcgtcggctgcgcaacataacggaaattatcttccgttggttcaccctgtgggcgtgaagccagaagccaggcgtgatttgttgtcgattgttcagtcatagtgtcgtcctttgcatgggctaaccgctgcgggttgccgggaatgaatggctaaagtgtagatgactgaaaaaaggatgcttaaccctgctggcggttaacgggcaggagggaaagggtaagaccggcgcgcgacgcagcagcgcgcgtttctgttggggggattcagattgctctgaatcacccgcgcggcgtgacagtgctttaacgcgcgaagcgggttggcggtggcgcttttcaggaccgccgtgacagccctggtgtgagacacagccgctaaaactgcggaaaccgaggttagcagacctgatatttgtctctttctgcagtcgagtcaaaatcaagcctgcgccagtaacgacatgcacggcagtgacaggcttcagggcgttcatccagcgccataacggccatcaccgcatcaccgccatgacgctggaaagggcttagctaaacctttctggccggaaagtggcgagcatcggatgttgcacaccattgagtatttcatcggtgagaagctcgcccaaaatcagtgccagcgttgcgcccgaatgggtaaacgcaacaaagcaccccggcacttttttcagctccccgacaaccggttccccgtcacccggaaccggctttaacccgattttccagctctttgcgtccaggggtttaccctcaccaatcagtttaccggcttccgccattaactggctgatgaccgcctgatcaatgctgtactgaccatcggcatgcgcaacgatatcctcttcgtaccagtcatggtccaccgccagcgtattgcccggattggggcgtatcgccgcgcgcggcgtgttcatgacaacctgcaaaccctgattttgtgcagtgctggtgaccagcatggcgacaggcgacgcgtttgcaatgtgcacaccaagcggcgcaaccacctcgggtgtccaggggccacaggcgacaagcacacgatctgcgctaaactcaccgcgcttttcgctacgaatgcctgtcgcacgccccgcagtggtgattacgcttgcttttcccgcatgctcaacgacttcgccgcctgaggctttgaactcatgaatcagatgttccataagatggggcagactgacccagccttcacccggattggcaatcgcgacacgggtaagggcggttctgttcacctgagggtcaacacgatttactgtggtgtgatcgacaaggagagattcgtagccatgcgctttttcgtaatcatggcgcgccagggttcccgtatcatcgtcctcctcccagaacagcgcgccatcaaaacgcagccagtcgagatcgggatggcgtgcaaacagggtatggtaacgcgcaatccctgccattcttagcgcatgataaggttgcgaccgttcgcccgacgagttgagccaggaaagtgaacgtcccgaggccccggagcagagttccgcttcggttaccagcgtcactctggcaccggctttggccagttgccaggcggtcgatacgcccagcacgccaccgcccagtacaacaacggttttgactacagcttgttcagtcatgattgattcctttgttaaaaagttacgccgttcaggcagtgcgcacgcggttttgctgatgaagctgatcgataagcttcagtaccgcaagcgcctcatctgtctcgacaggcggtgggccgccatgcaaaagcgcactggcaagcaattgataaaatgcgggatagttaccgcgctgcaggataacgacatcgctttcctccgcggtccccatccggggataaccttcgggcggcgtaacgccgtactggttgtccgtgggcgacatgcctgcagccagctgtggctcctggttatccagtccccagtgggtaaaggcgcgcttgctgcccagcagatggaagcgcggtgcgttcagggcagcctgaccgttcatccacagccgcgaacgcacgccgtttttatgcagtaaggagacaaaacaatcctcatcggtgtccgactgttggcccgaatagcgggctaactcggcgctggcttcctctaccggaccgaatagctgtatggcctgatcaatcagatgactgccgagatccagcagcaggccgccgccttgtgcaagggacaccgtgtcacgccagttgccaaacccctcaggtcgccaccactcaaagcgggattcaaaacttcttactgtgccaaacgcctcttcctgcaccaggcgcttaagcgtcagaaaatccccatcccaacggcgattgtgaaagaccgtcagcaaggtattggcttgacgggcagcgctaatcatcgcttctgccgcctcgacgtcaggggcgaagggtttgtccaccaccagatgaatgccgcgcatactggcctgcaaagcctgttcacgatgttgtgcgggtggtgtggccagcacgatgagatccagggcgatttcaccgctgtcgataagctgcatcagcgaaggccagtccggcacaatccgtgcctgcgggtaaccttgctgggcggatgccacgcgctgttcatcgcgactgacaatcacgtcaagccggtaatcggcattgtgcgctagcagcggggcatgaaagacgtttccggcaataccaaaacccaccagcgccgtgcggacagggcctgaaacggtagaatgtgacatcagagcacctccgataaaaatcgctgtaaacgggcagactggggacgttcaaacagttgctcgggcgtgccggcttcgacgatctcgccttcgtccataaataccacctggtcggcaacgcgtcgggcgaatcccatctcatgtgtcaccaccaccattgtcatgccacgctggcacagctcggccatcagcgtcagcacgcctttcaccagttcggggtcgagtgcggaggtggcttcgtcaaacagcatcacttccggttccatcgccagcgcccgggcgatggcaacgcgttgctgctgccccccggaaagatcgcgcggtcgatgatcggtgcgttgtgctaatcccacttcggccagacgttgcctggcaatgctcagcgccttcgctttcggctggcctttgactttccacggtgccagcgccacgttttccagcgcgctgtggtcggggaacaaattgaagtgttgaaacaccatgccgatgcgcagtcgcagcgcatcgggtttgtcttttaataccgagcggccggcgagtaaaacatcgccgcttttgggttcatgcaggcggttgatgccccgcagtaacgtcgattttcctgacccggaagggccgataatgcaggttgtggtgccgggggcgatggctaacgacacattgcgcagcacttcaatcgggccgtatgccagggtcagattgcgcagctcaagacttgcgccatgaaaggcagaagaggttgccatgttaatgtccttgtccgctggtcagagaggcagtgggcgcgaccgcccgttttacctccacttcatcgatttcttttaaaccgctttgaggggccgcagcacgacggcgtccggtgcggtaacggatgtcgatgtggttcacggcgtgcgtgagtggcacggtaatcaccagataaaacaggccggccagcatcaggggagacaggttgccgctcagtaccgcagcatcctggcctacccggaacagctcgcgctgataagtcatcagccccagcagatacaccagtgaagagtctttgatgatggcgataaactggttcacgatggcgggtaatacacgccggatgccctgtgggatgatcaccagccgcatggcccggctataactcatgcccagcgcccgacaggcttccatctgcccctgttcgatgctctgaatacccgcacgaaagatttcacccatataggcacttgcaatcaggcttagggcaaagatgccgaggggataaggcgtggggccaaataactggtaactgaaacgcgccagcccctgaccaataagcaaaatggtgaggatggaaggcaggccgcgaaacaagtcggtatacagccgggcaggcaggcgcagccagcgcgaaggtgagatccccatcagcgccaggatcaggccgaaaaaggtgccaagtagcgtggccgacaccgagataatcatggtgttaaccagccccgttgccagcaactggggcaggacgtccatcatcgcagggatatcgaagaaggtacgcgaaagaatagtaatgagatccatagccgattctcttttgcgggtgacagacagggtccatcaccaggtacattcacacgcacaacgtgcgcggcgattaagggtgctggggcaggtactgtgcaggcatcggcgagcctgggaaccacttctcatagagcttttcccaggtgccatcctgcatcgcatctttaatggctttatccagcgccgctttgaacgctggcttgtttttggctatcgccaccccggcaggcgcatcaaaagaagggatatttgcggccatgaccagattgaagcgcgcggcataatctttggcggcttcataatcaaggaaggtggcatcaagcgtgccgttattcagcgcggaaaccgccgcgttgttgtcaggaaaccgaaccaggtcggtctgtttaaagtgctgcaacgcataggtttcctgcagcgttccctgaatcacgcccagtcgcttatgggccagcgtctcgacatttttcacgccagaatcactgcgcgttaacaccgtcaaataacccgccagataacctgtcgagaaatccacggttttttcacgggcgggggtaatgccgattgcggctacgcccgcgtcatattgcccgttggcgacggcgggcaggatggcagagaaatcttgcccaacgaaatccaccttatcgatcccgatgcgatgggctacatttctgaaaaattcgacgtcaaaaccggtgaaattgccgtttttgtctgtaaaggtataaggctttgaatcacccagactggcgacacgcaggtgccccggttcgattaagccatacggattgttatcacttgccgcgtgggcactgaagctggctgagagcattacagcaatgccaaacagggctgcggataaagagggtaaacgtttatgcgatgtcataaagctcttccgattttgcaggtgaaacgtcagagtccacttagccggcgatattatattgagaccggtctcagtgaggcgtaaaatgaaaccggtgcttgttgtgagaccggtctcaagtggatataatgatattaagcacacgctttaagcagcgtcaatccagatgttatcaacttgtgattcgaaataattatgacaacaaaaaaacctcaattacgggggccgacggtcgcggatgttgcacgccaggcaggcgtttccaaagcgcaggcagcaagagcgttaggcggatatggatcggtcagtgaagatgtacaaacccgtgtggctcaggcggcggaaacgctgggctatcggcccaatgaactggcacgcagcatgaacaccgggcgttcaaatacccttggcgtcattgtgggcgatatcgaaaacccccattttgggctggcattacgcggcatggccgatgttgcccgccaggcgggttttcatttgctcctgagtaacagtgatgaaaccgtggaagaggaacgggaagccgtacgtgtgatgctggataaacgcgtcgatggcatcatcgtggcgccctgtagctccctggcacgggataatgaacatctgaaacaggtgctggtggaagggcgggcactgatgacgtttgaccgctctgtcgaagggctggaggtggaaacgattcaggcaaactttctgaacgtggcaaagcatgccacggaattattactgaacgccggccaccaacgtatcgcttatctttccagtatgcgcatcgccacaccttattcccactctgtggcgctggggcccacgcctgtcgcgcaacgtgttaaaggcatgattgatgcgcaccatgaagcgggaaaggttctcgatccggccctggtccgtctgaatgctattaataatgactgcattgagcagatattaactgaactactcgcactctccgatccgcccagcgcattgatcgcctcggataatctcattgccatggggatactgcgcggactggcaaaacgcgggctacgcgtccccgaggatatctcgttcgtgatgtatgatgattttccctggaccgaactgatgacgccggcgattaccgtcgtggcgcagccagtgtatgagatgggcagagaggctgcgcgcaggctgatctgccatatccgacagcaaccggctggcgcgttacctgagtttgaaagctggatggtggtgcggggatcgattggcgaaaagcggccgaaagcgtgcagagaatctggcggctagcttgcgttgttggcagcaaccacggcaaccgcattgatccccagagaccgctgttcgggttgttatcaaccagcttatcagccgtcgtgatgtcggcaccttcactgcacgagccttaagaatctgcgtctcagcagttgaacaactgctattactgtctggcgctgggggggttgcccgccgccctcagtgcttgccacgctttctgattaatcgaataaaacaggctgggtggtgcattgtcgacatcatagatctcgtcgataaaccgcaaaccggttttttccagcacgcgtattgaggcctgatgagggcgtcttaccgaggctgaaatcgtctccagccccagttcgccaaaaccatagtcaacggcgaagcgtgacaactcggtagcgaaccctttgccccaggcgtgggtggcgaagcggtagccaaggttgttgacggtcctttcgccataggtgcgcacgcttaatccaccaaagccgatgatgatctctggcgcttcctgggtcgctatcgcccagctgtcatagccgtaacgctgaaacgacgccagtctgtcggccagcaccttttgcgcgtgggccaggtctggataagggcctgcggggttaaacgtattggtcgcggggtcgccgtaaatgctgaacagatccttgtcatcggaagggcgcatagctctgagcaacaaacgctcggtctgaagatgcactataaacctcactgtaaagctatctgaatgacgtattaatagcctgtttactcaacaaggagaagtgatgaatattcagcaaatgcgtattgcgcggcccgtgagcgatgtagccgcaagcagcagcctgtattgtgccggtctgggactcacgcgcatgggagaattcacggatcatgagggttttagcggggtgatgttgggcgataaaaccctgtcctggcatctggaatttacccaatgtcatcaccatccggtacaaccggcttcgacagccgaggatcttctggtgctttatctgccggatgaaacccactggcaacagcgctgctcagacctgacgcgcgcaggctttgtgagggtcaccgcgtttaatccttattgggagaaaaacggcgcaacctttcaggacaacgatggttatcggctcgtgcttcagcacggcgcgtggcaaccttaacgcctgccttttcagtttcgcgcgttacaggcgctttgtttcagttaaggcgaagcaaagcgcaacgcactatcgccgatggacgctaattttatggcaatcaatcaaacgttaatgcatggcatattttcatttacgttgtcgataaagcgaattcttgtctgtaaccaacagggttttacgactgacatcggatttttttaaaactcagcgcaacggttaagacacggaatttttcacaggcgctacagcaactgccattctgatgcccgatcttgttaacgcaatttccccgcgattcttttgcttttacctctaccgcacgcattctttttcatggtggctgaggtcagcgtgattcgtcgttaaacgccgtactgcgccgcacactttccgcatgagcgactaaacagcgatagcggacgtgatggttagcggattcgtcaggcaatgcccacgtctgccaaagtggacatctctgcgtgcgaaagcctggtattggtgcccggataaacgcatggcatgatagggaacgttttctagccaaagagccaacacgtgatcaatattgcctgcttacataccgccgccagcaatatcgccatctttgacgatgctgcccggcagcttaatctgacgcatctgcagctcagccatctggtcatgccgcacctgctggcggaagccgaagccagcggtggcctgacggcagggctttacgatcggctggtgatgctgctacaggatctgcaaccgcattttgatgtcattctgatcacctgttcaacgcttgggccggtttctgccgcgttttttccgctcaaaaaaccctgcgctgtctggcgtaccgacggcatgttggcaaaagccgtgcacagcaatgagaaaaaaacggtggtgctttgtgccgctgaatccacgctcggcgcaacacgggcactgttctgcactaacggacggacgcctgaagtacggcttatcccggatgcctggcagcgatttaaagcgggtgatgaggcgggatatcttcactgtgtgcgtacggcggtagaagatgcctggctgcagggcgcagagcaggtggtgctggctcaaagttcgatggcaccggttgcgcagttttttacaccgcaacgtcagccgctgtcagggcctcatctggcgctgctgcagtgtcatcatcaactcaaccgttgaggccgcaaccaggttgcggcccgtacaggttattcgtctggtttcagcgtgccttttgccccgtggggttctgagcgcagatactgtggcggtgctttgacgttggcgctaaattcagccgcggcgtgccatggccagcgcgggttataaagcattccacgggccagtgcgaccaggtcggcttcgtcctgttgtaaaatcgcctcggcctgctgcggctcggtaatcaatcccaccgcaatcaccggaataccaatttgctggcggatatcgcgcgcaaagggaacctgatagtttggtccgaccttgatctgctgctgttcagacagcccaccgctggagacgtgaatataggcgcagttcagggattcaagctgctttgataaggcgatggactggctgacatcccatccaccctctacccagtcgctggctgaaatccgtacgccaaccggaatctctgccggaacggcttcgcgcaccgcgttaaacacctctaaaggaaaacgcatccggttttccagcgagccgccgtattcatcgctccgcacgttagataacggggaaaggaactgatgcagcagatagccatgggcggcgtgaacttcaattaattcaatccccagacaaacggcgcgttttgccgtcgcgacaaaggcatttttaacgcgctcaagatcgctgacctgcatttccagcggaagatgctcgccatcactgaacgacagggcagagggggcaagggttttccagccgccatcctgaggcgcaatctgcttgccaccttcccagggaacggtacaggaggctttacgcccggcatggcctaactgaatcccgataggcatgtcggaatagtggcgaatatcgtgcaggacgtcagccagcgcggtttcggtttcatcgttccacaagcctaagtcgccgtaagtgattcggccaatatcttcaacggcggtggcttcaataatcaacaagcctgcgcccgaaagggcaagatggccaaggtggatacgatgccaggcggtcgcacgaccttcctcggccgaatactgacacatgggcgcaataacgatcctgttatccagggttaactcacccagagagaagggggaaaagagtttgctcataaaaacctcattgtctgcgctcggttaacagtctggtgaaaactatagtggctgattggcaaacgcgtgcgtaaagcagcgtaacaatttattggtgatgacggttaccgcctttagttacagcatacatataaaatcacaccaacaggtgcaatatgaagataagtcatgggctgtatgaagagaaatctgtcagcgtcagcaggaaaagagggcatgaacccttgctgttaatgccgatgataacagcagggttcagggcgtagaataacgcgttgcgaagattgatcggtcacaatcaggctctctgcaatgccttctcatcaagcgaatacagggtagcggtcgcttccagaatatgctgctggtcattacccggcttatgggaatcaacgtgggtaatgtgatagccgaccgcaccggcctcagtcgctttgcgcagcagtgcatccgtgatttcttccatcgacgttgcccaggtcacggtcgtcacgcccatcggcttgatggcatttttttcttcctgggataagccagtgcggataaaaacagggcttactgtctgaggagaaaagatagacaaaatatcctgaacaagtgctttcattttcgtgctcctgagtatctgaatttacagcatcacgcgcctgttaagcgccatcgatttattaattcgccatgggttcgattaacgcatgcatgttaaggactgtcggcaaaagttataaaataccttttcgagttaacgaatttggcttttcttgctaatcagatgcttatgaaagcttcagccacacttgagctgaaatatggcaggtttttcgtgtctgcttacaggttgtgaaatccagatacaaaatatcaacacaaaacaaacaattgagcggggagcgcattaatgcgcgccgcaaaaggcggattgcagcaggcttacagagctttacattgccaggaaaatcgcaaaatagccggtttatgcctgtaattgattgataaataacagatgtgaaaaatacgaaatttggcttaaggaaacaatccgttcatcaaccgaaggttttcataaaactgtcataccgtgccgcaatactgcgcagccacgaagtcacaaaaagacattttttgaaatcatttgaaacctgttttgcgttcaggcggttgctgcaattataaggagagttttatgtcacgccaacctcgtcaatacaatgcctctgcaacattttcacgacgtcaattaagcctgtgcctgctggtgctaggcagtatgacagccagtgcagctgcacctgccgtcgagatgaaagcgaaaaacgtgattgtcatgattaacgacggtgcagggtggggaacatgggatgcaacagcatactggcagtatggcgggcgcgacaaaactccttatgccggatttccggcaaaatatgccatgacaacctatccgcttaatgcttcgaaaaaggcgacacacagcgatgaatccctggttaattacgatgcgcagaaagcctgggataccacgaaaagagataacagggatctgccctttaaaggctatgaatatctggccattaaccctaccgacagcgctgctgctggcaccgcgctggcatcggggataaaaacctataacaacgccattaacgtcgacaataacggcaagccggtcgactttatcaccctcaccgccaaagcgcaggggaaagccacgggcgtagtcaccagcgtgccgttctcgcacgctacgccagccgcctttggggcgcaaaacgcgtcacgtaatgactaccacgcgatcgccagacaaatgctcaccgccggtcagctcgatctcatcatgggaaccgggctacccggttttaatgtgaacggaacggattgccagcatctggcacacaatgaatccacgacaggctgtggcgctgatgcgaaccgctatctggcgaacgccgagtgggatcagctgcgtgccggtaagctggcaccggcaggcggtcagccgtggaaaatggtgcgcagtacagaagcgttcacccaactggctaatggctctctgaactatgacggcccgctgctgggatcgccgaatgtggcacccaacggtacgctgcagcagggacgtcaggctgagtttgtcggtaaagatgccgctaacccgtccggcgatgcatttattaccaccgtgccaacgttgaatatgatgacccgaggcgcgatgcagcacctgagtaaaaatccggctggcttcttcatgatggtagaaggtggggcgaccgactggtctgcgcataccagcaacgcctgtagcggcaaaggcgactggggcaatacctataaccccaattgtgtgggcgttgaatacggtcgtctgattgaagaaagcgccgattttaataacgccgttgcctccgtcattgaatgggtcgagaaaaacagcaactggaatgagaccttgctgatcgtgacaacggaccacgataacggtatgccgatggggcccgatgcgcagactacagcgttccagcctgtcatcaataaaggtaaagccgcgatgcccggtatttctttccgtccgaccggtaatcactccaacgcactggttccgctgtgggcgaaaggtgtgggggctgaagcctttgcccaacgtgtacgtggaaacgatgcgggctatgccaaacatgtcggtttgaatgatggcaattacatcgataacaccgatgtttttaccgtcgtgaaggccgtgctggaaggaaaggcggttgaaaaaatcacgcccggacaggccagtaaatcctgatgtgacaacgtcacataaaacagggcgttttacgcttttcagatccacgcttttctcccggtgccggtggcgatagctgaccggcaccgttgttttttaacatcgtgatgaactcaaccatcccttttctgccgcttttttttacaacgtcagcaatattatgccgcctcattcgtctacctcatcacacaggattgttaattactgatgaggtcaccctgatatgagagatattgataaccatccgttccgtcatgcccgtggtatgggcagaaaccgactggcgaagccattgatcgtcggtgtcgttttaattgtcgcgctgtgtctgctggtcatgtcactatggaacgccttactgcccgccattattggggtcaaaacgatcggtttctggcaggctgcgggactgttgttactgtgccggattctgtttggcggattggggatcaggccggggatgtttggccatgcccgacgccgtatgcatgagcgctggatgcagatgacaccagaacaacgagacgcatttatgaagcaacgtcgtgacggttttggtcatcggggacaccattgccgggataaagcccggaacgaacagccgccgtctcccaatgacagccatgatgcccggactgagtaaatgatgaaggccagcgcatcgcaaacctcatcatggataaaagcgcttacgctctgcagaacaaaactccactcttttattcgcgcccgtacctcagcacgcgatgaggctgaggatattttgcaggaaattacctgtcagctgatgggtgtggaacagccggttgagaatatctccgcctggctgtttcgggcggcgcggaatgaaatgacggaccgggcgcgtaagaagcgggaactgccgctttccgtcttcagggaaaacgacgaggaggaggcggtagaaaacgaactggctgaaaccttgtttggccttccgcaaacgccagaagatgattacctcagagcactgctctgggacgcgctggaagaggcattatccgaacttccgcccgctcagtttgaggtgtttgatcagacggagctacaggggatcagctataaagcgctgtcacaatcaaccgggatcagtgttcagaccttgctgtcgcgcaagcataaagcggtgctgtatctgcgtatgcgtttgcgtgcggtctacgacgatctggtaaataacgactaaaaaaggcggccactggccgccagagtgcgccttatcatctggtctttataagaatgacaagatcagcctttcacgccaccggcggtcaggccgttcaccaaccagcgttgcgccagcaggaacaccagggtaataggaatcgcagagagaacggcggcggcggcaaaatcgccccacagatagttttgcgggttaaggtattgctgcattcccaccgccagcgtgtagctgttgacatcgcgcagcagtagcgaggccaccggcacttcagtcaccgcagcgataaacgccagaataaacactaccgctaaaatgggcaccgacaagggcagcagcaccagtcgaaacgtctgccacggcgtcgcaccatccagcgcagccgcttcctccagcgaaccgtcaatggtttcaaaatagccctttatcgtccagacatgcagcgcgatgccgccaagataggcaaagatcacgccgccatgcgtattcagcccaataaacggcaggtattgtcccagacgatcaaacagggcatagagcgcaaccagagagagcaccgccgggaacatctgaaaaatcagcatgccttttagcaggctttcgcgacctttaaagcgcatgcgggcaaacgcataggcgcaggtcgtggacagcgccacaatgcccatcgcgctgatggctgcaatctttaccgagttccacagccacagcaaaacaggaaagggcggcggcgtaaccgagccgtcggcatgctgaacgctgaaacccagcgccagccgccagtgttcccaggatatatgttcaggaatgatactgccggtggcgaaattgcctgcgcgcagtgaaattgccaccaccatcagtaacggaaacagtattgccgcgataaaggccagcagcagcagatgcgtcatcaacagacgtaacttttgcgatttgggttgcaccatcgccataacgactccttaatcaaatttcatccgcacggctttcagattgatcaccgccagtgcgccaaccagcaggaagatcagcgtggcgatagccgccgccagaccaaagtcctgaccaccaccgccttcaaaggcaatacgccacgtgtagttcaccagcaggtcggtataacccgcaggcgtggtggtaccgagtctgtcgggtgcgccatttgtcagtaactgcaccagcacaaagttattaaagttaaaggcaaaactggcaatcatcagcggcgtcagcggctttaacagtagcggcaccgtaatcagaaagaagttttgtagcggcccggcgccgtccatcgcagaggcttcatacaaatcctccggaatcgccttaagcagccccatgcacagaatcatcatgtagggatagcccagccaggtgttcacgatgatcaacatggcgcgcgccagcgtgggatcgctgaaccacgcgggtttgataccaaacagggcgttgagcatcacgttgatctcaccaaagctctgattgaataatcccttgaagatcaaaatagagataaaggcgggcaccgcataaggcaggatcagcattacgcgataaaccgctttgccttttaacgcctcccactgcaccagacaggccataatcatgcctaccgccaccgtcagcaccacggtcagcaaagagaaaatcatcgtccagccaaagatcgccaggaagggtttttgaattccctcatcggtaaacacccgaataaagttcttccagcccgcgccgacggtaaagccgggactcaggcgttcttccccccaatggccatttggctccaccgcctgataaaaaccggtatccagatttgcgcgataggtcacgccgctttgctggttttttagcgtttgactctccgttatcacatacagcgggcgcgtcccggaaaactggcgtagagaactcatgaccagctctcgaccgtcaggtaattcagcccgaatcttcgccagtgcctgacgatgtgtcgtgatcacccgtaagtttgcccgttcgcccgcaggcgcaggggcgctgaccatcttgaggtgcgctacgcgagcaatgtcaaacgccggtgatacccaggttcggttatccgtgctgtcggtaagaaccaactgccagcggtcgcctgccgatatcaggttgaaattcaggcccgcgccgtcctgatattgcctgctgagcaggacctgctgcgcacgttcctgggtcagttggttagtgctgctgtagttggtaaaggcaatgcccaccgtgcaggccaggggaaacaatacaaacagcatcattccggcgatgccgggataaacgtaacgccaggcgtaggcccgacgattggcataaatccagatgcccagtccgctcatgaccaacgtcagcagggcaaacagatattccccctgcgcgtacatcagcaccagcaggtaaccgaccagcagacagcaaatgcccaccagtgcgcctttcaacagagaacgatgccgtcccgcttgcggtttttctgacataacccgatttccttaacggcaggttgcaggccagcaaaacgggcctgcgttagacgatttacttgttaagacgtgactgtgcatccttgagcgcagcatcaaccgactgacgaccgctcagggcgttcagcgtggcggtgcgcatggcgtaccagaacgcggacatttgcgggatattgggcatgatatcgccgttgcgggcgttgttcatggtggcggcaatacgcgaatctttctccagcacttgctgataggacttcagcgcgaccgcgcccagcggcttgtctttattcaccgcctcaagacctgaatcggttaacagatagttttccagaaactcttttgccagctctttatttggactggccgcattgatgccagcactcagcacgccaacaaaaggcttcgtgggcttaccctttaacgtcggcagcggcgcaacgccatagttgatcccgcttttatcgatattgctccaggcccaggggccgtttatggtcatcgccgtctggcctttattgaaggcggcttctgcgatggaataatccgtatcggcgttcagcaccctggctttaacctgatccaccaggaactgcatacccgcttttgcccctgcattgtcgacgccggtgtttttcaggtcatagcgcccgtcggtcaattgataggcataagcgccccctgcggccagcagcggccaggtaaagtagggctcctgcagattaaacatgatggcgcttttgccttttgcgcgcagggtcttatccagtgcggccatctcttcccacgttttcggcggagcaggtaacaggtccttgttataaatcagcgacagcgactcaaccgacaccgggtagccgatcagcttgccattgaagcgcaccgcgtcccaggtaaaggggaagattttttgctggaaactgctgtctggcgagacttccgctaacaggccagattgcgcgtaaccgccaaagcgatcgtgtgcccagaagataatatcggggccgtcaccggttgcggctacctgcgggtatttttcttccatcttatccgggtgctccaccgtgacgtgaataccggtttcctgttcaaacttttttccaacctcggccaggccgttatagcctttatcgccgttgatccagatgaccagtttaccttcttcaatcttcgccactgcggaggccgagaacagcactgccgagagggctgacagcgccaaaattttagtgccggttttcatctttaacactccatcctgttagcggaaacgaacatgttgcttgcagcacattctgcgtgttctgaccggcttctcatcctcctgacgtctacgcctgcccgtgctgagttgtgatcgccgttgcaaagtgaccgggttatcacggtatggctcacagaaaagtgggggccagactgcgttgccgatcacaaaaatcagtgcggcacagggcggctcgcgtgcgctggggcgttctcctcctcccgtctcctcccccagctaaagcacggcggtggaggatgtggcggctaagcgcgcgacgcatagtgggcaccagaatctgtccgctgccgtgcaggctgcattagcgagtaaagaggaaagcactatggcgagcgtcgtgttacgcaatgtcaccaaagcctggggcgacacggtcgtgtcgaataacatcagcctggaaattggcgaaggggagtttgtggtgtttgtcgggccgtcgggatgcggcaaatccacgctgttgcgcatgatcgccggtctggaaaccatcacccgtggtgatctgttcatcggcgataaacggatgaatgaggtgccgcctgcggaacggggcattggtatggtatttcagtcttacgccctttatccccatcttactgtggcagaaaacatgtcgtttggcctgaagctggcgggggtcaaaaaagccgagcgagcgcaacgcgtgacgcaggtcgctgaggtgctgcaactggcacacctgcttgaccgccgtccaaaggcgctctctggcgggcagcgtcagcgcgttgccataggccgcacgttggttgcagaaccgcgcgtgtttttgctggacgaaccgctttctaatctggatgccgcgttgcgggtgcagatgcgcattgagatctcccgtctgcataagcgcctcaagcgcacgatgatttatgtcacccatgaccagatcgaagcgatgacgctggccgataaaatcgtcgtactggacgccggtcatgtggcacaagtgggccgaccgctggagctttatcactatccggcaaaccgttttgtggcgggatttatcggatcgccaaaaatgaatttcctccccgtgaaggtcactgccaccgcgattgatcaggtgcaggtgcgcctgcccaatagccagttggtctggctgccagtagacagcgccgatgtgcaggtcggcagcaatatgtcattaggaattcggccagaacatttgctgtccagtgatatcgcggacgtcacccttgagggtgaagtgcaggtggtagagcaactgggacacgaaactcaaatccacatccaaatccccgccatccgtcaaaacctggtgtaccgccaggaggacgtggtgttggtaaaagagggcgccacgatgggcattggcttgccacccgagcgttgtcatctgttccgcgaggacggacgcgcgtgtcgcaggctgcatcaggagcccggtatttagtccggaaaaacaataaaagcaatgacctcaggagatcgaaaatgttaactctgcgcaaactttcccttgccgtggcgctggcgacaggcacgctgtcttcgccacttatggcggtggattttaccggttatgctcgttccggcatcggctggacgggcagcggcggcgagcagcaatgcttccaggctactggcgctcaaagtaaataccgtctgggtaacgagtgcgaaacctacgctgagctgaagctgggccaggaagtgtggaaagagggcgacaagagcttctatttcgataccaacgtggcgtactccgtttcacagcaaaatgactgggaatccacctcacccgctttccgtgaggcgaacgtcaaaggtaaaaacctgattgatgcgctgccaggctccaccatctgggccggtaaacgtttctaccagcgtcatgacgttcatatgatcgatttctactactgggatatctccggcccgggtgccggtctggaagatgtcgatctgggcttcggtaaactctcgttcgctgccacgcgctcatcggaagcgggcggatcttacaccttttcaaacgatcggattcgtgactacgccaccagcaccgcagatgatgtgtttgacgtccgtctcgccgggttggaaaccaacccgaacggcgtgctggagctgggcgtggattatggccgtgccaacgcgcgtgacggctaccgcttagaggatggcgcatccagagatggctggttgttcaccgctgaacatacgcagagcatgctcaaaggctacaacaaatttgtgctgcagtatgcgaccgacgcattgacgtcgcagggcaagggactggcacagggcagcaatattaataacaacggcaagatgtatcgggtgctggatcacggtgccatcaccctggccgagcgctgggacctgatgtatgtcgcgatgtaccaaaacaccgatctggataacaaccgcggtaacgagtggtacaccgttggcgtgcggcccatgtacaaatggacgccgattatgagcaccttattggaagtcggttatgacaacgtgaaatcccaacaggttaacgaacgcaacggccagtacaaaatcaccctggcacagcagtggcaggcgggcgacagcatctggtcacgtccggcgctgcgggtatttgccacctatgccaaatgggatgagaagtggggttataacaaggacgcgtccggcgatatcaccacgttagcgtccaaagacactacaggaaatggcctgttcaccaacagccgcggcaataatgatgagtggacctttggcgcgcaaatggaaatctggtggtgatcccttcgctgagtcattcacgctaaccgtttcgctatgactttcaggccgcggcggctattgcctggcatggcgcggcctgccattctttgaggttaaaaatgaaaacgtataaaacattcaccgcactttgcctgagcgcgctgctgctggcagggcacagcgtgacggcaagcgccgagatcaatctgatgccgcaggatgtctctgccgcgcccgctattccggcgtccagtctgcagcacattcactggcagccattggatatgtctcgcccgcaggtgacaaccttaccgccgggtaacagccagctgaaccttgccggtatcactggcccggtcgccgcttacagcctgcccgccaatgtgggtgagctaacaatcaccttaagcagtgaggtacagcagaaccaggtctttgcgcccaatgtgcttatcctggatgaaaatctgcgtccggctgcctggtttccgagccgttggttttcttatcagcaaccgggagtgatggctgccgaccggcttgaagggatgatgaagctgacgccagtgcccggacagcaaaaaatctatctgttggtgttcaccacggagaaggatcttgcccaaaccacgacgctgctcgatccggcaaaagcctatgcaaaaggcacaggccatgcggtaccggatatccccgatcccattgcccgtcatacaacatctggcacgttaaaaatcaagctgagtacccgccaggattcatcgatactggttgggccgctgtttggatcgtctggccccgcgccggtgacggtaggcaacagtcaggcgacagtaagcagtcgcgcacccgttgcggcacctgccgtgaaggcgcagccgattgtgcaagacaccgaaagctattttaacgacaacattcgccaggcggtggcgcagggcaatattgataaagcgcttaaactgctggatgaggccgaacggctcggctcgacgtccgcgcggcaaacatttatcagcagtgttaaaggcaaggggtaaaaaccccgacagtgctgatttgttgcacctggtgcgctaaggcgcaccttttttacgcttatgatcagacaataatgtcatctgatccgacgctgagcatgacaaaatatcccgcccgttactgaagccaaggcgacatatcattacctgatgaaagggttaaacaggcaccatgtattctttttgaaactgctctttactgacaggacgagaaaaaagaaaaccttgcccatattttaccccacgatgaagcatggtagaaatgtgagtatagttctccacaccttcgacaataacatcgcaatcataactatccagatattcgagcatcatgaacgtgtcattgaggttattactggcaaggcaacttctgtccagcttaatataatcaggctgaaaggtgtccagttttcttttcagcttatcaagacagtctatgccatcccaggcaagattagcacccgcgtcccttagctgttgaagattatctatcattgtctgctcaggttgttcagcgctgtcggtgacttcaaatataatctgctgtggtgttatctgatattgctccagcaggccgttcgcgcgagctgcaaaagcgctatcgtttaactgaacctgagaaacattaagagtgaatatctgcttatcctttatttctcgcggttgttcagcaataaattcgaacagccggaccataatataatcacccatgagtaatatgccgcctgtcgcttcgagttggctgatgaaaaaattaggtggaacaacattacggcgatgttttccccgaaccagtacttcgccgccgatacaggcgacacgggaaagatcaaaaatgggctggatcataaaatcaatacccgcatcgattttgttcttttcgatacactgaaccacgtaatgtgaacttttttccatgtaagcctcattaaataaatgaatatattaaaaaacgacacaacccctggcgtacttaaccttatgaaaataaaaatcacactgccacaagaagaatatagaggatcggcatgacagagagggcatccgccggtagctggccagaaccgccatcaggtctggccaggtattttttgtggaagaggctatgccacggtgcccacaatgtttaaatcactgtcatcaggaacttcattataggaaagcacatgtaagccactcgcaaacaagcggctgtagcgtgaaataagcggacgtagctgtggcgtcaccagtaacagcggcggtaatcctttcgctttcatttgttcctgaatcatgggcatggtgttttgaagctgcgtcagtatattagggtcgacagggaaactgtccagcgcaactttccccgcctgctgcgactgattaagtgcactcagcaaaatactttctaaattattatcgagcgtgtacgccgataagtgtttacgatcgccattaatgctgtggatgatggcccgacgtagcgcatagcgcacatcagcagcgagtaaaaggggatctttcgttaccgctgaactttccagcagagtggcggctattgtcacaatatcctttagcgaaacctgctccagcaatagctgacggtaaacacgcagaaggacactgaagttcagggcgtgggtcagatcctccgttaatttgggcgcctgctgtgccagtcgcgcatgtaagtgcgtaatgtcatcgtagttaaaaaggtcaggtaagtattgccgggcaactttattgacgtgggtagcgaccacactggcgcaatcgaccacctgatagccaagattgagcgcatgtgctttttgattcggatctatccatacaattgccattccgtaggcgggatcgatatcgagcacgccatcgatttcgccatataactctgtgccgggaatcgccatcagtttatccgcatggacttcgcccaccgacaggcgaataccattaatatagatggcatattgagcgggtttgaggcgaaagttttcacgaatccgaatctcaggtaacaggataccgcactgttcagaaacgacctgacgcacaccacggatacgctgtgaaagcggattccctttactgctgtcaatcagactcactaacttatagcccaggttaagaccaataggttcaaccagggggatgttttcccagccgatcttcgtcgcactatcgtcgttcagcgcggcgttaatcgcatcgtaatcaacgtcttcttgtgccggtttaatcgctttactttgtcgccaggcggcaaacaacagcagcgcggtaaaacacagaaacgcaacgtggggcatgccgggcacaatggacagaataaacatcacaaacgcagcggtataaagcacctgtggcctggctaagagctgcgtttttatctcatcgctgatattgttgccgtcactcacccgggtaacaatgatggcggcagccgttgccagcagcagggaagggatctgtgccgcaagaccgtcaccaatggtgagtaaaacatattgctgaaaggcatggctggcatcaagatcgtatttaaaaataccgatgcaaataccaccaatcacgttaatgatcagcaccatgatgccggcgatggcgtcaccacggacaaatttagaggcgccgtccattgagccatagaagtccgcttctttcgcgacctctttacgacgggcttttgctttttgttgatcaattaatcctgcattcagatcggcatcaatcgccatctgcttacccggcaatgcatccagcgtaaaacgcgccgagacttcggaaatacgttctgcacctttggtgacaaccacaaagttgatgatcatcaggatcataaacacgacaaaaccgacgacaaaatcaccgccgatcacgacctgcccaaaggcctcgatgacctgacctgcggcaccttcgccttcatgtccatgcagtaataccacgcgtgttgaagcgacgttaagggtcaaacgcatgagcgtggtgatcagcagcagcgtcgggaagaccgcaaagtccagaggacgttgcatattgaccgccaccagtaagacaatcacagacagcacaatattgaaggtaaataaaatatccagcattaagggtgataaaggcaacatcaccattgccagcacgctaagcagtaatatcggaatgccaatattgcctctgcggattagagcaaggatttgctgtaacttaccggtcgccatgggctttaagtacctctttcggaatcgttatttgtttgttcagatggggtttggacatcaactgacctgttcgccatgacttcagttgcatgacataagtcagaacatgtgcgatggcacgaaacagctgggccggaatctgctgattaacgcgggtagtgtgataaacagcgcgcgccagcagcggaaattccacgacttccacctcgtgctgctgggctacttcacggatataaagggcaatatcatccatgccttttgccacaatatagggggcttctgccttgtctgggtcatatttaagtgcaacggcaaagtgggtagggttagtaataatcacatcggcttcaggaacggcacggttgatctgccccattgccatctgccgttgtaactggcgaatacgccctttaacctgaggattaccgtcattatttttgtactcttctttaacctcttgcttcgtcatgcgcattttttttgtaaacatgaatttactgagcggaacgtctaaaaacgcgaagacaatgatcacggcgataaagtagatcagcacaccatgcagaatgccaagcccctgatgaatggcctgattcagattgagacgctgaaggtgcagcagcggattcagggcgttgtgtatcatgcaatagagcacggccagaataatgccgcatttcagcagcatttttccgacgtcaacataatgactggctgaaaacatgcgttttaatccgctgatcggatttattttttttaaatcaggcttgagtttttccagcgtaaataaccaaccgcccggcaccagactggccacaatgcaggcaacgggaatcggggtgagcgtggcgataaaacgcagcaaaacccaaacgttaatcaacagaaactgaccgagaacatcgtcgtctttgatctggcttgccattgttcctgctgcggtaaatgattcttcaatcaggtgtttgtagtaggggaaaaaagcactcagcgtaataaaagaggtcagaaggccggcagccatcgtcagatctttggaacggggaagatcgcctttatttcgcgccttacgtagtttttgcgcggtaggtttttcgcttttatcaccagacgcagccatcagtcattcctcatggcttccattcttgccagaatgtcattggtcagattgaggtaatgatcagggatattggtgatcatcattgaaatacacagcaggccaaacagcatgctaatcggaaagcccagcgaaaaaagattaagggtgggagagacgcgattaagcagcccgaacccgccctgcacaattaacatcacaaatgtcgtgggaagcgcgatcagcgtggctgaagacatgatccagcccagcccctgagcaataaacatcaattgcggggaggtaatagctgttcctatcggccaccagataaaccctttatataaaatggtgacgaccagtaaatgcccatccataacgaaaaacagcaatccgcagaaggtataaatgatttgggaaataaccgtagttgagctgccattaaccggatcgttcatcgtggccatacccaatcccatattcatggataaaatatgtccggcggtctgtaacgcaacgaaaaccaactgcagcgacatgccaaacagtaaaccccataacagttgttcaccgattaacagtatcgtgcgcaccgagagcagtgagccaggcagaattttttccggcagcatcggcgttatcaccacgaccagcgtcagggccatcgcgatttttattcgtcggctaaatgcactgttatccagtaccgggcaaaagtggataaatgccatgatgcgggtaaaaggaaacaccagcgccagtagcgggtctgtcagggtatgaatatcaatgctcatcgccatcaacctaccagcgccgctgcctgctgaaaaagcgtgacggtaaaatccaccagttgggtaagcatccattttccgccaacgattaacacggtcagcgtcaccaacagacggggtaaaaaactgagtgtttgttcgttgatttgggtggtcgcctggaagatgctgacgcacaggccgacaatcaagctgggaataatcgccacggcagagatgataagcaccagcttgatgcctcccgccataatatcgccggcaatgtccattgtgaccatgattaaagcccctgcacgctggatgtcagggtgccgacaatcagcgtccagccatcacacagcacaaaaagcatcagcttaaaaggcagggaaacaatcaacggcgataacatcatcatccccatagccatcaatatactggcaacaattaaatcgatgaccaggaaggggatgtaaatcataaaaccaatctgaaaggcggtctttaactcactcagcagataggcaggggtgataatcgtaagatcttgtgcttgcggttcgcctgtcaccctggcaatggtcatcatttgggacagggcttttgtattggtttgtgacagcataaaatttttaaagggcgtttctgctttgctaagcgcctgtttcagggtgatttcatcgcgctgaaatggcacgatggcatcctgataaaccgtcgtccagactggacgcataatcagtagcgtcagcgccagtgcaataccggtgagaatcttattgggtggactttgttgcaggccgagcgcctgccgtaaaatagccaggacgataatgaatcgcgtaaagcaggtcatcatcaataccatgagcggcagcagccccagcaatgtcatcagaatcaggatttcaatctttacgttgtagtcctgacccccttcagtaactgcggtactgagcagggtgacatcgccttgtgcggcatacagcaacggtgaaaaaagcaaaccagacagtagcagcgaaaacgtgccggttttgcgcaacggattcatcgtgtcagttcgcccaaattgttactgttgaactccaggatacgcaaaccatatttatcattcagcatgacggcttccgccttgccgaataaaataccattgactttaatatccagggcttcgcctgccattttatccagttcaataactgaatcatggttaaccgttagcaaatctgcgagtgatatttcgaccgaagcgacttccagcgtcaggttaaccgggatacgactgaatagcgcgattttgcgtaagtcatcattttcattgacgacgtctggtttttcctgaatatcaagccggatgttaccttcaactgttttttcgcgtgcgatgtcgccaatgttcaggtcatcaaaatccagggactggctaaggtcttgttgtgcatcactcatgatatttctcgatagttctgtcattaaattcacaaaaaaataacttgcctcggtcttcggcgatttcagcatcaaagatttgctctttcccaataaaaaccgggacaggatcattaataaggacaggaataatatccccgggttttatctttgataactgagcaatcgttaaattcaggcttgcgaccttaccgtttaacttcaaaggcatgctgtgaaacagtcgctccagttgtgcctgagtcggtggcgtttgcggcgcgacagccatatttttttccggtgcgcgtattttggctaataactgatcaacatggttgtcatcgaataacagggtaaaattgccatgttcatagccctcaagcgtaaaagttacgcaccatgcccattgcgtcattaccgtcgtgctgtcactttttattgcaatgtcctgaccaaaaatttcgctatcaatgagcaggttggtaaggtcaaggccgatttttgtttttaaacgtccttctgtctttgttacgggctgattaatatctggtgttaaattgttgttgtctttaccgagcccataatagtcatgaagtatttgcagcagaagggggcgttcaatatcaaaggcaattgaaccaaaacaggtagagaaaatttgtgtgtttttataggcttgatcgatactaaatgacaatgattttaacgcaatattaacccgtagcttcttgagaaaataaatactgatgcgtgaatcaaagatatcaaagttatcattcatcactttcggtaatttatgccagggccgaccaagcttactgacatcaagcttcacgatgtcagtgagttcctgacgctggtatatttttattctttgaggcgctacgtgcatacttgttccgcatgaaaatgatgagcaatgaattacaatgccgatgatttgacctggatcaggttttccaaaccggaattgttatgggtgcttatccagtattgcttttctgtctcactgctttttgttttataacagaggtgaattaaacccttttttaataagcgggtcaataaaccatgaattattaattcattatacttaaattattaattacatcttattataatcgtaacttactgattttaaacgattaaaaaattaataccaattaatagcgcgacaggttgttttgcatggataaactaaggccaattaaaagaagtcttcggcaatcattcttattcccctctttttttgaattagtggttgcattataaatgcgttcgctgtcctgaggcgatataggctttcaggtctgcgaaaggtaaatgaaaagtgatgagtggtggattgttatgcgttttttgaatgagtgcgatgtgcgcgatgaaaacaaatttgtggccagttcgccagaaagcttaagtgtattttcattagctcgccgcgtggcgaacttcaatgttgctgtactcatcacaggtgagacggggacgggaaaagagtgcgtatcgcgttacattcatgaaaaagcctcgggctgttcggatgcaccctatgtgggggttaactgtgccgcaattccagaaagcatgctggaagctgtcctgtttggttatgaaaagggcgctttcactggggcagtgacgggcgttgccggtaagtttgaacaagccaatggcggaacattattgctggatgaaattggcgatatgccgttagcgttacaggcaaaattattgcgtgttttgcaggagcaggaagtcgaacggctgggaagtaataaacgcatcccgttagatattcggctaatagcctccaccaataaagatcttcaaaaagagattgctgaagggcgtttccgccaggatctgttttatcgtatttccgttgtgcctattcatatcaaaccgctgcgtgagcgacgtcgagacattattcctttggcactcaggtttattgctaaatacaaagatttccataaagggaatatgcagttaagcgatgaggcgcgtcaggtcttactggaatacgactggcccggcaatgtgcgtgagttggaaaatgttattcaacgcggaatgattttaagtaatggtgaagagatcgccgccagtgatcttggtcttcctttacgcaggtcactggaaaaacccggtccagacataatgccagaatatcgtgaacagctttcagtgccagcctccgcaatgagcaatgtaaaactccacggccgactggctgagtatcagtacattattgaattactgaagcgccataacggtaataaatcgaaaacggctcagtgcttaggcattacaccacgtgcattacgttaccggttggcatcgatgcgtgaagaaggcattgacgctgaatattactcataacaggcgtaagagattgaagcattgaacaagattaacaccatcggtttcgatataggggcaagccagcaggcgatgctggcaaaaatgcaacaggctgctgcattggcgtcatcaggcattcatccggcagcaccgtcaacggttttggcctcatccttttctgagacggcggcgacgaacgcttattccttttcgcaggtgctgaatcaggccattgacaatgttgacgctgtgcaacatgccgccgctgcaaaacagcaggcgattgaaatggggcagagcgacgatctggcgggtgccatgattgaaacacaaaaagcgagtgttatgttctcagccatgatgcaggtccgtaataaactcaccaccgcactcgacgaagtcatgaatacttcgctgtaaggtcttctcgtgctgaataagttaaaagaaaagttttcagaatcatcacttcctgtgggcctgctaaaaccaaagtggctcattactgttggtggttttttgctggggatggcgattgttttttccctttggcgcaccagccatggctacgtgccactttacggcagtcaggaacgcattcccgtcgcccaggttgttgaggttcttggtgcggaagccattgcctatcgcgttaaccccgacaatggtcagattctgatccgggaaaatcagttaccacgtgcgcgtatggcactggcggctaaaggtattacggcggtgatgcccgatggctacgagctgatggataaagacgagatgctcggcagcagccagtttgttcagaatgtccgttataaacgcagcctggaaggtgaactggcacgtagcattatggcgcttgatccggttgaatcagcgcgggttcatatggggctgagtgaatcgagttcatttgtgttaacccataagccgcaaagcagtgcctccgtcgtactgcaattacactatggaaaacagcttgatgagcaacaggtggcggctatcgtgcaactggtcgctggctcggtgcccggtatgcaagccagcagcgttcgtgttgtcgatcaggcagggaatctgctgtctgacaatggtccgcagggcgccagtaacgttgccagtctgcgccaggcacgggatgtgactgggcgaattaaacaagaaacgacggccaatattgctaagttgcttaatccactttttggcagtgaaaactacagtattagcgtgacgcccaccgtcgatatgagcagtgtagaagagacacaagaacgcctgggttcagagccaaaagtcagcgacgaaaatatctctcaggagaacagcaccaacgaactggcgattggcatcccgggttcgttaagcaatcgacccgttaacccgtcacctgcgccagcccagcagaccgtgccagcagcgccccagaccggggaacaatctcagcagcaaccgcagaacaacgacccacgttcactttccagccgtagccagcaacaacgcaagtatgcgtttgaccgtgatatccgccatatccgtcatccaggttacaagctggaaaaacttcgcgtcgcggtggcgctgaacgaaaacgcagaggccttagcaaaaatgacgccagagcaactcagcacgctgacacgtctggttgaggaggctgcaggcatcgaaaaggcccgaggagactcgctgacccttaacaagatggcgtttgttcacctggcgaccgatgtagtgccggaactgcaatggtggcaggacccgtcaattcagtactggggacaaaatggcggtattggcatcctggcactgctcaccctgatatttggcgtgcgccccctggcacaacgctttggccgaaatgaccttatcgaaaaccaggagaaagacgtcatcgttccagatacagcgccagcaaaagaactgatcgccactgacgcgggccttcagggtctgcccggggccgcattcaataaggataccgagctgccaccgcaaagttccggcctggaaaccaaagtggaatatctgcaaatgttggcagagaaagaaactgaacgtgttgctgaagtgctgaaacaatgggttaacagtaatgagcgaactactaataaacaagaatagtaaaagcagtgttaaaacgggaaggaaccgcctggaacaggccgccattttattgctcagtgtgggggaagaagccgctgccagagtaatgcaaaagatgaatcgggatgaggttctgttgctgagtgacacgatggcacgcttgcatggcattaaggtcgatcatgctcgcaatgcaatgaataacttttttgatgattaccgtgagcagagtggcatcaatggggcatcgcgtacttacttacgcggcattcttgaaaaagcgcttgggggtgaaattgccagcagcgtgataaacggtatttacggtgacgaaatacgtcatcgcatggcgcgcttgcaatgggtagatgtcccccaactggccgcactgattgagcaggaacatttgcaaatgcaggcggtatttcttgccttcctgccgccggatgtggctgcctgcgtactcagcgtgctgcctcaggaacgtcaggatgagatcgtctggcgcattgcccgccttgatgacattaaccgtgatgttatcgatgaactcgaccgcctgattgaacgcggtgtcgccgttctttctgaacatggttctaaagttctcggcatcaaacatgcggctaacatcgttaaccgtattccgactaatcagcagcaactgctggatcagctgcgggaacgggatgccgaagtggtggatgaactggaagaagagatgtacgaattctttatcctcagccgccagacaccggcaaccctgcaacgcctgatggaagagattccgattgaggaatgggctgtggcattaaaaggcaccgagccggttctgcgtcagaccatcttcaacgtcatgccgaaacgtcaggtggcactgttgcaatccacaacggcgcgaatggggcccgtacctgtaagccgaatcgaacagattcgtaaagatattatgatgaccgtacgacaactggcggaagaaggggaaatccaggtacagctgtttgcagaaaagacaatggagtaaccatgtttaaaaagcacagtttacccttgagtgcactcactgacagtcgtgatgccgttgttaaaccgcgcctgcataaattcccgccattgcgtaaacgccggcaggcatcagagagtgatgtgttatcgcctgaagaaggcagtgccgccgtccacgcgcagttgaagcatggctttgaagagggcatgaatcgtggtttcgcgcaaggcatggaggagggcaaagaagaaggctatcaggaaggcgttcgccttggtgttgaagaagggttgcgtaagggactggcagagggaaaagttcaggcccgccagcagtttctggaagcggcccagccgctggacaatcttattcatagtgtctcgtcgtttatggccagttacgaacagcgccgtcgggaagaactgctgcaactggtagaaaaagtcacccgccaggtcatccgttgtgaattaacgctgcaacccacgcagattttgacgcttgtcgaagaagcccttgcagcattaccgcagcgaccagaacagatcaaagtgctgctcagtagcgatgaatatcgtcgtattagcgaagctgaaccggaaaaaaccgcccagtgggggctgatggccgagccgacgcttgccccaggtgagtgccgggtcatcactgacacgacagaaatggacgtcggctgccagcatcgtctggaccagtgcatggacgtgctgaaagaaaacttattaccggacacccatgatgagtgataacgcgttcgaacaggctttacgctctatcgataagatccatctcgccagagtggcaggacgcctggtccgggtggccggcattttactggagtgcgtcggatgtcgtctggcggttggacagttctgccagattgaaggcattgatggccaactgattgatgcgcaggtggtgggtttcgatcgtgatgtcaccttcctgatgccttttaaacacacttccggactcattgccggtgcacgtgtctttcctctcgacaagcagcagggggttctgattggtgaccagtggttgggccgggtggtcaacggtattggcgaaccgattgacgataaaggcaaactgtcaggcgatagcgtgcttcctcaacaggtgacacaagtgcaccccttgcgtcggcagcccgtcgtggcgccgctggatgttggcgttcgggccattaacggtttgctcaccatcggtaaaggccaacgcgttggcctgatggcaggcagcggtgtgggcaaaagcgtgctgcttggcatgcttacccgttatacccaggcggaagtggtcgtggtcggattaattggtgaacgtgggcgtgaagtcaaagagtttattgaacactcactgggggaaatcgggcgtcgtaagtcggttattgtggcggcacccgccgatgaatccccgctgatgcgaatcaaagccaccgagctgtgccacaccattgccagctattatcgtgacaaaggcaaagatgttttgttactggtggactccctgacccgttatgccatggcacaacgtgaaatcgcactgtcactgggcgagccgccagccactaaaggttatccaccctcggcatttggtctgatcccccgcctggtagaaagcgccggaaacagcgaaagcagcggctccatgaccgcgatctataccgtgctggctgaaggcgatgatcagcaggaccccattgtggattgtgctcgggcggtactggatggacacattgtattatcgcgtcatcttgcagaggctgggcactatccggccatcgatatcggacagtccatcagccggtgtatgagccaggtcacggatatctcacatcagcgtaacgcgcgtacgctcaagcaactctacgcagagtatcaaaatattaagcctctaattcccttgggtggttatgtcgccggcgcagatccaatggcagacaaagccgtcaatctcgctcccgcgattgcccgttttttacagcaggaggtgcaggatgcggcatcgctggagaaaaccctttctgacttagacatgctggcgaaagcaggataattcatcatgagcaaactgatacacacacttgaacaacttcaccttctgcgccatcgcgcggtgaacgaccttacccgtaaacttgccagtcagcagcgactatgccagcgcctggaaaacaacattcacgctttatccgggctaaagcagagcgtgcagtccagccaggaaaacgcggtgatgttgagcaatcagtcggtgtataaacgcaatctgcaacgtgttatcgactggcaaaagcaggagcaggcgctggcgaacgtcgaagcacaaaaaatacagcgccatttactggctgagtttcgacgggaaaagagcattgaacacgtcatggatgcacgaaggaaaacgctcaggcaggcccaggatcaacgtgagcaaaaaaccacggatgcgctgtcgacgcagagttggttgagacaacagacatcacggcagaaataagatggctgaaacaccaaccctgatgcggtcactgattaaccgccgacagcaaaaaagaaacagcgaattaccctttgtcagtgtggtatgccctacctggaatcgtcgggcctttttaccttatcttctgtatatctatcagtatcaggattatcccgcgctcaaacgcgaactgattattctggatgattctgctgaaagtaatgaagatctgatcgcgatgctggtcgatcacacctgtcaacatgtgcgctatgtccacagcccggttcggctggatttgggtaaaaagcgcaacatgctcaatgatatggcccgtggtgaatacattatctgttttgatgatgatgactattatccccccagcaaaatcagccaccaggtggcgtcgatgcagcgtaataacgcgcgtttctcaggctgcgatacgatttatatctggtacagccatcttgataaaatctaccgcaccgtttcttttggtgaacggcacgcgttgaacggcacctttggttatcaccgaaattacctaaggaaccatcgctataacgacagtgccacgctggctgaagagcaggcatttctgaataatttcaccacacctgtgcagcaaattgatcccaaagaggccattctgtgcatctctcacagcgccaatacttacgataaggactttgtgctggggtcgtcacaaccggtgaatttaacgctggaagacttcgtgaccgaccgtaatttgcttaatcactatcgacgtctgggacaggcgccactcagcaccgtggtcgcctggcaaacctttgacaaaatcgcggtgctttatgacgccacgcagcctgaagcactgcagcagcagcggcagaaactgaccttgcttggggttgatccgcagcagatagtgccgtttgcaaaacgccgcgccgctgacgccagcacagcagaactggcaaaccactgtgaggtattaacgcatgcgctgcatcaccactggacaagcgtactgctgctggacgcggcggtacgctatgtccataaagaacgatcgctcaagacgcttaaccatctgttagtccgtttgccgcatattcactggcaggtaaccttgctgggtggccgctatcatcgggttgtccccctcaacgcgttgcctggcgtgtcacggattactgatggtgactgcggttgcgcctatgccgttaatggcaactatatcccaacgcttcttgcccattaccagcgggcaattcagcaggggaattcactgaatgcctgttggaccgagcaaatgcgggaccattgctggcttggtctgcagccaggtttcgcttttttatctgaaataaccgatcccattaatggcgcggttgtcgactgtactcactggtttttccgaaaaaaagctcactaatcagtgccgcttaacgggcggccggagtattacaaatggaattaattgaaaactatcgtccagaatatgttgttcgcttcgatgccatgccagcgccctgttgttgtccctcttgccaggcatcagagcaggatgactggccgagagtcagcattaaacttaaaaatcagcagcggcaaagcctcaatgcaggatgcgaaactgccgcaacggaaatcctgttaaatcctcaggcctttatcctgcataccacccagaccccatgtcaggatcgtcgcgaactgacgcaatgggatgaaaatttaaatcaacagtgcatcaatctggcagtgcacccggcattagccttagaaaccagtttgtatgcgattggcgtgctgcttagtaaaacccagcatcaccagagcaacgggcagcatgacgtgcaactgctggacacgatgggggagcaactatcacaacttgcggataacggcattcttgagcagcaacatgggatgttgccgtcaatcgaaagtaatcgcatcgatgccctggcacagatgggggcgcttcgtttaaaccttaatctacccgcgacccaaaaaatgagtatgatgcttaaactcagcgaactggccgttatgtcaccttcagcattgcaacaacgattacgaacgctggaaacccttgctgccagcaacacattctttagcgaacatccccacatcttacgcaatctgttgatttatcgtctctatggtgaggtctttccctgtggatgtgggcaacattatggtcatgcatttctgttactcactcgccagatatttgaattaaaaatgttgtgcgcgctgtggctggaagatcataaccggttgatgccgcgcgatctggtaatcctggccagcgcctggtttagctggcagcagcataaaaccccagaggctgacagtgaagacagtgcggattatatgttgctgtgtggattgtcattgatttaagcaacggcgttaacaaatagcctccagtgatttataaaacagggggcgataatcgacatgccgttgctcaatatcacttctgtcagcctgttggaaccctgcacaagggtaaaggccaagccagcaatcttttgccattaactgccaccagtgtacatccagagcatagcgttgtggctggccaccctgttccagaaaccgcagactctggcgtaaattttccagcagttgcgaaaaataatgctgtttaacccaatatgcacacgcacaccatgcccgattaacgcgcagcaggtaatcgacacttttcaaaggggtaacatgttgatagttggctgcaagaaacgccacgtcccagtggacattccccaggctttgcagccagagattgagacgcgtcaggctgggggcatcatgggtaaattcaaaatcatcctcaagaatcagaacatcttcccaaccctgggcgatcgccatttccagtaccgcaatatgtgattttacacatcccaccgaaccggggctggcctgtatagcgtcaaagcgtaagaccttctctttaggtgccttcagttctctcagatgacgtttcatgcggaaattacgatcgcgccggtgcggcagattaatatagatcacctgagaaaaggtcgcccagtcaataaattgcatagtatgttgtatcgaataaatgtgcggataacgttcgccggacaggagaatctgtgctgacgtctccccggtaaacagaaaatgaaaaggacgttttaagcggcttatcagtaaaaggcgggtaaaacgcgcggcccaatgatgcgacactggcgcccggtatgtcagctgtacctggatcgggcttaaacctgctgataaagccagttctcgggttcacctacgttaaccagtttctggagtatgtcctgctgcatactgacaacaagaccattaccgtcattcagggcctggcattctgtcgccacgctttccagcgactgccagagtgggtcaagttgagcctggtgcctggcaggcaggcgggaaaacaacaggcgcaagcctttggagcttgcaggaatacccaactgggtcagcaactggtaacgctgctggctgttgtgggcgagttgctcataaagcgcaaaaatttgcggattcagccggtccagttcagcaacatcgcgggcaatcagcgcctgacgttgctccctgagcagggctttaagctggccataggtttgattatcttcaaccatatcctgcaccagctgttttacgcactgtgtggcgttactcatggttacctctgatgatattgctcgatggcgtgggccaatgcatccaggtcaatgctaatttgcccattggcaatggcgtctttaacagcagccacctgcgccatatccacctctggtaaagcagagagtttagtttgagcctctccgatcaccggatcgattgcggcagaacggctaattttcatgtcttcacgacctgcgctgcgagaaggcgtggtagcgttggcctgattgatcgcgcgggtcattgcatattgggtcgatgttattttcatcatgtagctccatgttcaggtctgtcatgcacatctcaaagcggaagctggacttccgtttgccttacctgctcaaagcgacgtttgagggcgtcaacttaaacgtcagccacctgttttttcacgcgaggcagcctgcgtggttctgaccatccccataccgatcacgatggcgttcacttcacgctcgctgttttcattttttattttaatcatttcgcctttacgtccttttttgatggcaatcccggtggtgcgggcttcaacgccatcctgttcagcaatcatcgttacccgctggccgcgctcaacgagtaccggagaatcgaacaggttcggggttaacacctgcatttcacgcacccggcgcttcagtgtaagcccggttatatcgtcaggatgggtcaggtaaccactgcgcacttgagtgatattgaattttttctgggtgacgtcggcagggccaacaatatgcccacgttcaagggtgtttttggccacaagtaccggcatatagatatcgggttttaccgtgacaggcaccgcccaacctttgccgctttcacagcgaacgtcatagcgcagccggcgtaggtcaggccgctcacttccagaaagcgtggccttaagtggcgtaacgcaaggcggaagttgggaagcttcagcggggataaacaggtttaatttggcctgataacgctgccagcgctgctgattagcctcattccgaatcgcctctgctgccatttgccgcacatgcacagagacttgtttataggcgctaaccgactgggcagaagcaggtggcaccgccaggcaaaaaacgctgagtattacgatgacttccttgcggaaaaaacacttcctctcttcgacgaacttcctacaaaaaactatataattcatgatgttaataacctggcacgatagttgcttattagttggggcagcacaggctatcgcagcggtcattatcacgaaggagtgagttgtgagtattagttttgaaaaggctttgggcgttcatccgcaagctgtagcacttcgactttccagggcggaactgctttcagcaaacctggctaacgttgatacgccgcatttccaggctaaagatattgattttgccgcggagatgcaacgttcacaacagggttatttcccaggcacctcggcgcaagagaggtatcgcgtgccctggcaacccgcttcggacggtaatacggttgcgcttgatgtggagcaggctgaatttgcaaaaaatgttcaggactatcagatgagcctggcttttttgaacatgaaatttaccggtctgaagcaggctatagaaggtaagtaattaattcaggtgacgagaaatggcttttaccgatatttatcgcgtttcaggttcagcaatgacggcacaaaccctgagactgaatacgatcgccagcaatctggctaatgccgaaacccctgcgctggaggagggcgatgtgtacaaagcgcgtcgtccggtttttgctgcagtttataaaaacgatgagttgatgaatcacaacgggctatccggtgcgcgcgtgcaggtactcgatattgtggaaacagacaatgcgttacagcgctatgaaccgaatcatcctatggcaaaccaggatggctacgtctggtatcccggcatcaacgtggtggaagaaatggctgacatgatgtcggcatcgcgcaatttcgaaaccagtgtcgacgtgcttaataatgtaaaaagtatgcagcaaagcctgctgcgtctcggcgaggcgtaaccgatgagcgtgaatggtgtttccactcaatctgttactaccgcctatggcagtagcagcagcgtttccgcaaatgacaacagtgcggcaggaatgaacagcctttttttgcaattgctggtcgcacaaatccaaaaccaggaccccttaaatccgacggacggtactgaatatgttgggcagcttgcgcaactgactcaggttcagtctatggaaaccctgactcaacttatggccaacaattccgtgttgatggacaacctgcaaaccctgacaaccggcaacctggttgggcaacaggtcatggtccagacggatacgatcaatagcgatggtgtcaccacgcttgaaggtcgattcaccctcgatcatgcggccaattccgttacggtgatccttaaagatgagacaggaaaggaaaccgaaattgagctgggcagacaagaggtcggcgacgtcaatttcaacattaatccgcaggcattgggattgagtgaaggtaaatacagcatttcgctcatgaccgacgccgaaaaaagtcacgtcccggttgaaatcggaggacgagtcagcaacgtgcgcattcctctggatggcagcgcgacggtgttgaatatcattgggctgggagaggtcgcctacaacaagattacccagtttggccaacccgacgactaaacaatcaacaagttatacgttaaccaggatctattatgagttttgatatcgcaatttcaggcctgaatgccataaaccaacagcttggggccatctcaaataatatcgctaacagtggcactgtagggtttaaatccggccgggccgagtttgcttcacagtatgcggaagggcaagcgcttggtgtgggagtgacgaatctcgctcaaagtatttccaaaagcggcgacattttttcctcttccaacagccttgaccaggcaatcaacggcaacggcttcttcatgctgcgcgacagttccggtacgacatcctatacccgtgccggttatatgcaaattgacagcagtgggtatctggtgaataaccaggggatgtatttgcaaggatatccggttgatgccaacggtgtcgtgcaaacgggaacgatcggcaatattaatatcagcagtggttctatccccgcgaaagcgaccagcacactcgattttacggctaacctcaacgccaacgtcgccttacctgaaaccaccacattcgatcctgccgatgagtcatcttataaccacacctatgcaagccaggtatatgactctttaggacgagaacacaccctgaagcagtactttgttaaaacagatgataatcaatggaccgtccactactacatggatgataccaggctggatgccacacaagagatgatctttagcgagcagggcgggctgactgtacctaacggcagcgtaagtgtcactgcgaacattgtgggggctgaagcgattgaacttgagattaattataatggcaccacgcagtttggggccgacttgtccgtcagcaaaaacaatggcaatggctacacgtcaggcgaacgaaccgggcaagcgattgaaagcgatggcagcgtctatgccaccttctccaatggaaaacggatgctacaaggacaactggttctggccaccttttcgaatcccaatggtttgtcttcgcagaatggcaccacctggtcccagacctctgcgtcgggagaggcgctgatgggcacgcccggcacagggctactcggtgcacttagctcaagtacgcttgaaggttctaacgttgacctgacgtcggaactggtctcgctgatgacggcacagcgaaactatcaggcaaacaccaaggtcatcagcaccaatgacagcatgatgactgcgcttttccaggcggtgtaatggaccacttaatctataccgccgtcagtggcgcatcgcggagtctgtctcagcaacaaatccatgccaataatctggccaatgtgaatacacctggtttcaggcatgacctggataaggcgctgtcgcaacagattcaaggggaaggtttttcctctcgctatctggttcagcagcagcaggcaggcatcgatatgacgcctggcccgacacgtcagacagggcgtgagctcgatatcgcgattaaaggtaacgggctgattgcccttgtcagcggtaatcgcgaagtttacacccgcaacggccagatcgacgtgagcccggacggggatctcaccattgatggattacccgtgtccggtgataacggcccgattgtgctgcccgctttttcctctgtcagtattgccgacgatggcatcattactatcgtggccgaagacggcaatatcgcggcaccgatggatgttgatcgtatcaaactggtggatattcccgcctccgacctcagtaaaaacgccgccggttttttagtcaccactgccaatgaaaatccgcgcagcgaagaggtggaagtggtagcgggccatctcgaaaactcgaacgtatcggctatcaatgaaatggtcgccagcattgcgctgaatcggcagtttgaagcacagataaaaatgatgaaagcggcggaagaactggctacggctggcaaccgcctgctgcgtaatagctaatttcgtggttacaactgaaaaggaaacgtcatgaatcccgctttatggatcagtaaaaccggcctggcggcgcaggacgccaagatgagcgccatctctaataacctggcaaacgtcaacaccaccggctttaaacgtgacagggtcatgttttccgaccttttttatcaaaatcagcgtgttcccggcggtcagttagacgaaaacaatatgtctcccaccggaatacagtttggcaccggggtgaaaattttaggcacacaaaaagagttcaccaccggcaacattcaaaataccgggcaaacgctggatgtggcgataaccgggcagggttttttccaggtcgaaaacagcaatggcgatctggcctatacccggtcgggttcttttcaaaagaatgctgatggtttattgaccaactcccaagggctaccgctgaacccacgcattgagttacccgataatgtgacggatctccacataggtaaagatggcacggtaatggccacgatagcgggggaaaccgacctggtggaactgggccagatcacattggttaattttgtcaatccggccggccttgaggccattggcggcaatctgtatcgcgaaaccgcagccagtggtgaagcgatagagggcatcgcaggggaagaggcatttggtcaacttgaacaaggctcacttgaaggctcaaacgtccaggtggttgaagagatggtcgatatgatcacggttcagcgcgcttatgagatgaacgccaaaatggtttctgccgctgacgacatgatgaaatttgttacgcagtcgatgtaatgcatgaagtgaagacgaaatgaaaaagcagatagctttactctttatcgcagtgcttctgtcaggttgtgaaagcccggcactgctggtgcataaagatgatgtggcctatgcgccacctgaagattttcacatgccacccgtgcaagtgcagggcggtggtctttataacgccggttataactggtcactcatccaggatcgccgggcttaccgggtgggggacattctgacggtaaaactggatgagtccacccaggccagcaaacaggcgaaaacaaatttcgataagaaaaacgatgtcgcgctgggcattcctgaagccttaggtgaaacagtggagaaattttctggcgccgtcagcggcaaccgaaactttaatggtaatgcgaccagccagcagcaaaacagcctgcgcggcgccattactgtcgccgtgtaccgggtattgccaaatggtgttctggcggtacgtggcgagaaatggctgaccctaaaccaaggggatgaatatatgcgcgtgaccggcctggtccgtgcagacgatattgaacgggataactcagtgtcatcccagcgcattgctaatgcgcgtatttcttatgccggacgtggggcgctgagtgatgccaattccgccggctggttgacccgtttctttaaccatccactcttcccaatttaatggagcctgctatgcgtaaagccatactcattttgctgctgttatgcactcccggcttacgggcagagcggctagggaatcttgtggatattcagggcgtgcgcggtaaccagttggtcggttacagcctggtcgtgggcctggacggtaccggtgacaagaatcaggtgaagttcaccagtcagtcagtcaccaatatgctgcgtcagtttggcgtacagttgccgaccaaaattgacccaaaagtgaaaaacgtggcggcagtggctatcagcgcaacgttgccgcccggttatgcccgcgggcagaacattgatgtcaccgtttcttccatcggcgatgctaaaagtttgcgaggcggcacattgctgttgacgcagctgcggggtgcggatggtgaagtctatgcccttgctcaggggaatgtggtggtaggtggggtaaaagccgaagggaacagtggttcaagcattaccattaatacgcccacggtaggtcgcgtacccaatggcggctcggtggaacgcgaaatccccactgactttcaacaaaataatcaggtcattctcaacctgaaacgtcctggttttaaatctgccaacagcgtggcagtggcactgaacagcacatttggggcgggaactgcaacggcaaaaagcgccaccaacgtggtggtgaatgctcccttgtcggccggcgagcgtgtggcatttatgtccacgctggaagatgtacaaatcgatgccggcaaacagcagccgcgcgtggtgttcaatgcccgtaccggcacggtcgtaattggtgatggcgtcgtggtgcgtgctgcagcggtttcccacggtaatctgaccgtgactattcgtgaatcgtcgaatgtcagccagccgggtgcctttagtcaggggcaaacggcggtaacgccagacagcgacatcaatgtgaatcgtggaaatgggcaaatgctgaccatcgccgccggtaccagtttgcgcagtatcgtgaataccataaacagtttgggtgcttcgccagatgacaccatggcgatattacaggcattgcatgaagccggtgcgcttgatgcagaactggtggtgatttaaggagaacgcatggtacaggcgattacttctggcaaaaacatgttgccagcagacatgggtggtgaggtcaaaccgcaaaatctggagcaggccgccgagcagtttgaagcgatgtttctacgttcaatgatgaaacagatgcgtaaagcctctcaggcactggcggacaacaataatccgttcgacagcaaacagcagcgaatgatgcaggaattttatgatgacaagctggcctctcagctggcatcacaacgtagcaccggcattgcacacatgatcatctcacaactgggaagtcgggctgatgaggcgcttaagattgcaccggacagggtcgctttaaatcaacattctcagcaattagcgccccctgtgctccccgtaatgtaccgtgggcaggagtaaaaaatgaacatgataaatatcgcctggagcggtttgcaggccgcccagttagggatgagtgtcacctcaatgaacatctcaaatatgctgacgtcaggctacagtcgtcagggtattatccagagttcagtggtcactatggggcagggaggattatcaggcggtgccggggtacaggttgaaagcatacgccgtatttccgatcaatatttaaccaatcaggtctggcagagtaacagccaggctaactattacagcctcagcaatcaatatctcagctcactggaaaaggtgattggcacagattcaaccagtctgggcacaggactggatgacttcttttcggcactgaatgcgttaaccacccagccagaaagtgaagctaaccgccagcagttactcaatcaggcagattcgctggcaacgcgcttcaataatatgaatgactttatcaatagccagagaagcgccatcgcgagccagcgtaatacgttggttgagcagatgaacacgctgacgtccggtatcgcggattataaccaaaaaatcatccagatggagtcgacgggcgggaatagcaatgtcctgcgcgatcaacgcgacgaactggtaaaacagcttagtacctacagtgatattaacgtgactgaagacagcacgggcagttacaccgttgccatgaaaaacggtcagccgctcgtcagcggcaatgtcgccgggcagctaaacatcaccacagacagcaatggcaatcagctgttaggtctgcgtttcgccgaaagcgagttttcattaacgccctcgacaggaggacagctgggcgcattgtacgactatgaaaccggcgatctggctgacatgcagtcatccattcaggggatggccgaagcgctcaccaacgtattcaatgaacagctggcccagggttttgacaagaatggtgaacccggtaagcccctgtttatttttgatctgaaaaaccctgatggcatcttaaaggttaacgatcttaagccggatgaactggccctgtctgcgaacccggatgagcaggggaacggggataacctgcaaaagttgatcgatctgaaaaatcaaaaggtcaatatcggcggaatgggcaacatgagccttaacgaaggggcggcggcgattatttctaacatcggcattgccagtaaaaaatcgcagagtgagctggaggcggcacaaagtgtgtatgaacagtcgcagttgcaacgcaacaatcttagctcggtcaatcaggatgaagaggcaatcaatctgcaggtctacatgcaagcctatcaggcaaacattaaagtcatttctacaggcaatcagattttcggtgatttacttggcctgttttaacctcagcaaggagcgtaattatgcgagtgagtagtctttataattccgatgccatgcaatctcagctcaatgtaaacggatcacgcctgattaagctgatggagcagatgtcgacgctgaagcgggtcaacgtcccgtcggatgatcctgtcgccgcgacgcgtatggtacaacttaaccgcgagcaggcagccatcaagcagtatcaaaagaacattacggcactgagtggctcactggctattcaggagtcccacgtcagtgcaatgagtaatcagcttttagcgctaaatgataagttgctggtcgccgcaaatagtacgcacaacagcagcgacatggcaggtttcggtaacgaattgtcgtcgatgctggattctctggtggcgtctgtaaatgcccaaaatgaaagcggtggttatgtgttttctggcacgaaaacgaatgcacagccgatcgtctgggatgaagagaaaggcgtttatctttatcagggcaaccacggcgtgcgtgaaacaacggtagcaaatggcgttaacattacagagaacaccaatgtggttcaggcattttccagtgaaggtgacgacctggcgttactgaataaactgaaagacctgagtgagaagatgaaaaaccccgatataccgagcacggaataccaaagtgagatagatgatgtgcttgcactttcatcaaccagccgcgataaagtggccgccctgtttaccgaactcggcggccgccaaaatcgtctgacgatggtaggggatgcgcatgtcgatgtcagcatggcgaatgagcgagtgataagtgatttgtcggatactgacctggcaacatcgagtatcaatttgcagctgtatgttaattccgtccagattaccaacaaagcgtatagcatgatcaatgagctatcgctgttcagcatgttgtgatgccatgcaaataggcttaaaaacaaccacagggtcggcgacggctgcgtttatccggacgccggccgacacgacgcagcccattacggccattgatcgtacagctcgcgatcgtgcggttgtggcgcagtttccagaagctgcgctgctttcccgtcggccgctgcgttacaatattcaactcaaccgccagctgaccgccatgcagcaggcggaaaactatctttctgaaaccgagaagcacctgttagtgctgcgtcaccaggcagcaagaggcaatgtcgtcgcgccgctggcgtcactacaccaactgcttcaacagcgtagtcaggcttcaggcggcaccgtagatcgaaatcttaacgtgacgctgcaacaaaaaagccatgttaatttcacgttgcctgcgatagaaaacgtcctgcaacagccaggaggggagatactggtatttgccctgggcgggaataaacgtgaatatacggcagtgtctttaccgcagcagccttcccctcgccagacattgatacaactgaatatcgggctcggacgcctggggattcacgccgctttaaacgatcagggcaagtgtgtttttcaggtaagtgaagatcggtggacacgggtaaaccaatacctgagtgttcgcggtgaaggtctgcattttcctgctgatgcatttaccctgctaacttcgcaggctgaagccagttgcgaagatgaaatcggtttattaagccaacaatggacgcgcggtgcttcggctaagcttcagaacacgctaaacaaaatcacccgcgaaagaacaaccctgcatcatcatcaggagcgggtttcctcccgcatcaaggatatgtcgacgttctatacgccaaaggaggcactggaaacgtcccgtgcgctgagccagattctggcaaacagcatcgaccagtatcaactgctgtcaaaagcgctgtcggtacagggaaacgttcgggcagcaaccgtcaggaatatcctggggtaatgcggtaggttgcggataaaagcgtgcaagcacggtgacgcactgaaaccggttaaccgcgcgccaacaggaacctatccctctttgttgggttccggcctgatgtttcagccatcatgggggtgcagattttcagaagggcttgcagggggaagcggtggtggggagtgcggcgtgtaaagtatgagcacgccattttcagttgctatcaggggctgcccatgcacatccatcgtttgtgcccagatacctgtatgctgcaacatgtctgccatgccttcaagcatcgcatttgattgcgaaggctggtagatgacgggattgtaagaaaaaaaatgatgtccgctgatctcattggtttccgtaaaattcgttttaagcatgaagtggctatcttgcgcactggttattgtcgcgagatgtttgccgtcttcggttttaacctccgcgttataaatctcctgtcgctctgacatcacgtcgtaaaacccaatttgcaacgaagcacccgcatgatgcggggcagggataatggggtgaaaatagaaaacaaatgcaaaaacgagcgccgcgcaaagcacgccggctccaagccattttcctttaggaacaactaaccatctcattcatttttctcattgtttcattaaatatcaggctgtttgaccgcgcatgactggtacgccagtggtaaatgaccataaccagttgtttgttgtcacactgactggctaaagcaaaagagtaattgagcgtttgatcctgtgtacggtagtagattttcagggtcattcccctgcttttgatctgctcattcaaagcaaaaagcgtatctttaatgctgaaataaacatgatcttcatcgatcgcggtgcggtcagggctggctatttcatacatttgaatatgactgtattctccggcgtgctgttcgacagcggccaaccgtgcagtgcgggagttcgcacactcccaactgattgccgcgctgaatacaacgacaagcagcataataagaaagccggtcagcgaatggcggcccggcatcgggccgtctgcggtgggcagatttgagccgggaagcggcgatgttgcgggtgaaggcaagagaaggggaagcgtgggcgtgtcgcttttcgctatggcaatgacgggctcggggataaccagatcggcatctgttttaggcggcggttcactctccgtgacatctttttcaaaagactggcaccatttcttttctaacacatagcctttcttcggcacggttttaatgattttttgcgttttaccgtcatcttcaagcgcaatacgcagcgcatgaattgcactgggcagactgttgttgccaataatccggccttcccataccagcgtagtcaactcatcacgaaggagtattttccccgcgttttcagctaaaataccgagtaattttaattgaaattcacccagacgttttttctcacccgattttaaatggatgattgagcaagatggcacgtcaaggagccagttattaacaacgtagtgagtcttacacatgttaggtaaaggtgaattaccactcctgaatggactatcttcaagctgcagtataatacggatgaatattattaaccgtacatgaatcgttattctttcgtgtgccttgcggatcttgccacggggcctgattatttcggctaataacgtcgctttttattgacctccttattagcttacctgccataagtgtagtctgtaccgcatcgcccggatgagggcgacttcctatggggggctattttcacgcgaaagaatgtgatgcgcaacacattattaaggtttgatgctgcaaacttgtagcgctaataggcttaacgttaactaataacgcgaaatgggattttttatgacgtaaattaacaatattgtaatgcgctgtcagtgcaggatgaagaaagagaaatagcgcgctatgccaggtaagtaatattaacctcagcccctgggtgtcgtctgacaggcatttttagtgcctgtttattgcacggcctggttcttttttttcttatcataaaattattttcatcacctgtttaatttgccgaatccctgtgccgttttataggactaccagatgaatgaatctgaaaggcagattcaccaggagattataaatatggcactttcaatttttactaacgcttcttctatggcttccgtgaacgcgctgaataaatccaacagtatgctttctactgcgatggagcgcctgggcaccggtaaacgtattaactctgcagccgatgacgcagccggtttacagattgccacacgtctgcaagggcaaacgaacggcatggacgtggctcagcgtaatatctcggatgccactgcacttttgcaaacggctgaaggcgcgtttgatgaggtgagcaacattatgtatcgcatgaaagatcttgctacccaggcatcgaatgacaccaacggtgcagaggatcgcaaagccctgcagtctgaaatggatgaactgaataaagaactgacaaacattatggacaacaccaaatatgccggggaaagcctgtttggcagcactggcaaattaagtaaagcaatgaacttccagatcggtgcgtcgaaagatgaaaaactggaagtcgacttcagcgcggaattgaccggcgtgactggtgccagcggtatggcaggattacaaaccgctgatgcattaaccacctcatccggtgcgcaggatatgattggcaaagttgaagatgccctgactcaggtgggtacactgcgttccaaattaggtgccaatattaatcgtctgggtcatacgtcttctaacctggcgaatatgaaagacaacacggatttagcattgagcaatattcgtgacgctgactttgcttcagaagcatcgaacatgacgcgtaaccaaatgctggtgcaaaccagtatgtcaatgctgaaacagtctaacagcatgtcaagcatggtaatgaacctgctgggctaagtcacactgtcagaaaaaacaccgctttgcgcggtgtttttttttgcggaaagcgcttccgcctttatccaggaggaaggaagttttctttccgtggctcaatataactcattgtaaatacgtaattattaagttggcatgaaccttgctatacagaagtgtcattttagtagcaggtgcgaacaaggagatagacatggccgattttagcagtattgatccgcagagcctggctcagcagttggcagcgtatgacatcgtatctttacaaaaccagctgagtaccaaaacgacaacaatgaattctcaaaagaaggcattgaatgaattacgcacggcgttgactgatttccgcactgcgatgtcaggcttaaacagcacgaacgacggcgtgttgaagaacagcgcaacgctcagcagtaccagtgttgcaaatgtgacggcgaattcgaacgcgttaaagggcacctataacctggatgttaagcaacttgcctcctcacaccaaattggctttagcgacctgaccgacgaatccattagaaacgcgtccggaacgatggagattacgcttggtgaaggggagacggcaaaaaccatcacggtcgatctcactgacatggaaacactcagcgacctgaccaggaaaataaacaatcatgaggataatcccggtgtaaccgcttcgttgatgcgcaccgatggcaatgtggctctgatgttcagcagtgatgaaacgggtgctgccaacaccatatccattgggggaacggcaggcattgattcagccaatgccacggaaatttccaaagcggccgattccattgttgctatgggtgatatgacgttcaccaacagtactaacacactggataagctgattgatggcgtgaccataaatctgaaatcaacaacagaagccggcaagccgttgacgatctccgtggaaactgacacggaagggaccaaagaacaattaaaaacctttgttgacgcttataacaccttgcaggacaccttaggcaaactgaccaaaagcggcagtggtgaagaggagacgcgcggtgcttttgctggggatgccactatggtgtcgcttgatcgtgagttaaatcaggtcatgcgtcaggtttttggtggtaaacagatgtcagccttcggtattaccgccgataaagagggcaagcttgaaattgatgataccaagctcacggccgtgttgaaggaagatccacagtctctgaccaacttatttaatggcaaagaaggtctgctgtcttctatcgataaatcccttgatcgctaccttaattccagctctggattattacaaagccgtcaggatgtactcgatcgtcagcaaaaagatattgataccaaaactgacgccatgaatacccgctacaactcttcttataaccgctatctgaaacaatttacccagttacaacaggccatggcgcagatgaatagcaccatgagtatgtttggattagtttaaggaacacgatgtcatgtatcaccccgaacaaccaagcctcagtgaatatcagcaatccgacctgtctattcaggcagcggcggctaatccacaccagctggttcttatgctttttagcggtctgatggatgaactggtccgtgccaaaggtcacattgatgcccgtcgttatgaccgtaaagccaacagtatcaataaatgtatcgatattttgaatgcactgacgagtgccctggattttgataaaggcaacgaactggcgttgagcctggccaatctttatgactactgcgtttatcggctttacgatgccagccataagctttccgtggttgccattgaggaggttgaactcattctgggcaatattcaggacggatgggtaaaaatgggacaggcaaatggatgatatcgacgtcatgcgctcgctggctgactcacttgagcaggccgccgcgcatcaggactggtcaaggctacaacaggtggatgcgcagattgcatcgctcttgatctccctgaaagggcagtcgatggatacggaaaagcgcgaagctctccagcagcttcgcgctgttcaccagcgcgttaatcaatattgccaacataagcgcgacgaactggaaacagagatggcccgcacgcgtaataaccagcaaggtgcaatggcatacgcgcagttttctgacgcaaaggattaaacatgaatccggttctttcacagctgacgccgttatccgttaagagtgaatccgcgttgcctgtctccactggcacagcggcgatactgagtgaagatgtgacctcgtccgcctttaatgatgctctgctgggtatgctaaacaccctgatcacgccagatgcagagccagataccagcctggtgctcgccgggaatgacgttgagaatcccgccgaagcacattatttgacggaggaaaccgatcctcaacaactacttgatacattgctgatggcaagcgagttgccactgaacaatacggcaaaccggaacgcgttcctccgggctgatgaccgtttgataacgatggatttttcagcagaaccagcgtcgtctgcgcgtttatcggcaacgccgtcgcccgcattgccgccggctttaactgaaacagcggttaaccagctacggcaaatgaccgctgataatacaaagccgggaatgactgcggtcgtttcaccagcattagcaggggccatgtcaccgggtgtgatgacgtcagaacaccctcaaccggtgatgctttctacgatcaaccccgatactgacgattcattatgggcacagcaactccagggagccttgaaggcgcgtttacaggttcagatagataatcgggtccagcatgcgacgttgcgactggacccacccgaaatgggaaaaatggatatttccctgcaatttgataatgggcgtttaaacatacatatcagcgccagcaaccatgagacgcttcgtgccttgcagcagagctgtaacgagttaaggcagcatttaactgagcaatatgctttgcaggtaaacattaatgtttcatcccagtccgggcaacagcaggaacgcggacagcagatgtacaccccgataaaaagccccgacgctggcgctaagatcgcttctgaggatcattcgtccgcagaaggggaagacgatttacttttactaacggtttaacgatttattatgacaattaaaaatttttctctggggctggttattgcccttatcgcggccatttttgccgccgggctaactgtttttgcgacacagtatctgaatggggatgaacaaaagcgctcactgataaatgacttttttagtgcatcaaaagagagtgtggtggaatttgttgaaataaaaaatgttgtagttactttaagaagtgatgaaaaaagtgtccgatatttattacttgaattcgcactgacgacaaattcaaaagaggatgccacgcgtaccgaagatatgtcgccggcgattcgtggtgccacggtgaatctgctatccagcatagattataaagccgtgcgggcaatgagcatcgaagaacttcacgacaggttgatggatgcctatagggaaagctttaagagtctgaatacgcgtatcccatttaaagacgtgatcattaataaaatggttttccagtaatgaacaatcgctgatggaaatgatggattttattgctcatgacgcattgacgcccaaacaggaggcgcaatacgttgacgcctatttaccgctggttcacaaagtggttaaacaattagcatggcaaaccagtagtgttatggaccgggaagatatggagcagatagccctgatgggcctgctcacttccctccgccgctatgggcatcctgacgatcaattcgcggcctatgccgtacagcgtattcgtggagcggtgctggatgagttacggcagctcgactggcgtccacgtcgtttacgacagaaaagtcataaaaccaatgacgccatacgcgaactgacacgcaagctgggaagggttcctgaccttaacgacctgcgacagcatctcaccattacggctgaggagtatcaggaatatctgctgctggattgtgccaaatctctggagagccttgatgatttactcagtgaggatgccattcaaaacggcctgaacagcagaccgctggaagatgaaattatcattggccgaacattacgagctgcactggctgaactcgatgagcgtgaacagttaattcttacgctttattatcagcaagaaatgaacctgaaagaaattgcactggttctcgacctgactgaggccagagtttgtcagatcaataaaaagatagctcagaaaattcaatctttttttcagaagtgaacatttaatgcaaaagattcttggtgtttttattattttcggctgcgtaattggtggctttatgatgtccggcggcaacctgtcttcattttggcagccgggcgaaattatcattattttaggggccggattgggtgccatggtgttggccaatccgcggcctgtgctggcagaaatgtatcgtcagtttcggggcataatgaaaaaaaatgagtacaacacggaggaatatcagcgtcagctactcatgctgttatatgaattactggaactggtacaggacggtgggttaaaggtactggatgagcatattgaagtcccccaaagcagcgcgctgtttcaaaaatacccgttaattttacagaacgtcactatcatcacctttattgcggataattttcggctcatggcgatgggtaaaattaatgagcatgagcttgaaggcatcctggaacaagagttggtttcaatggaagagaatctgctgcagccctcacgctcactgcaacgtaccgctgaagccatgccggggtttggtatctgtgctgcggtactggggattattatcaccatgcagtctattgatggttccattgccattattggcgtaaaagtggcggcagcattagtcggcacctttcttggcgtgtttttttgttactgcctgatggaccccgtggcaaatgccatggaacaacggactaagaagctgatgtcggtgattgaatgcattcgcaccgtgctggttggccatgtggcagggaaacccacgctgttagcggtggatgccgggcgcaaaatgttacctctggattcaaaaccgacctttgccaccctggacggttgggtcaatcagatgacgggtgaactctgatgcgtggtaatcgcagtaaagaaaatacaaccatcatcaagcgttcaatgcacaaaagtcatgatgctatgcatggcggtgcatggaaggtggcctttgccgattttacactggcgatgatggcgctatttatggtgctgtggattatgggatcggtcacggaagacgaacgcaaagagattgtttcacagcttcagggcgaatctatttttgaaggccatacgttaaaagccattactcagcccaatggcagcggcgggaaaattgcggttaccgataagcgcgatcgcgacgcgcaaaaaaataaagaagacgcgaaacaggagcacgctcagacagtaaaaaatcaggtgctggcggcaagtggtgaaagccttgaagatgttaatgcgcgctcacagcgtgaaatagaggaactggcgcgcattattatggagatcacgtctgcttacgatgcccactcgaatctcaagatagaaattgtgccgcaagggctacgtatcctggtcgctgacgatcagaaacgagaaatgttccagcgcagtagcgccatattgacacctttttttaaacgattactcacagagttcgcctcggtacttaacaccattgataataaaatcattattaccggtcatacggattcgacccgttttcgcgatcaaaatcgctacaacaattggaatttatcaggggaacgtgccttacaggccagaaagatattaacggctgcgggtttggatcagaaaaagattttgcaggtcagcgccatggctgatcagatgttaatcgacgaggctaatccgctcaactcgactaaccgacgtattgaaattatggtgttaacaaaatcggcgagtgagtcgctatatcagttttttggcactaatggggggaaagttatcaaaccaatcgctaacaggctttctcagcagaattaaatggttatcggatgttcagcatagttaaatcaggccgaagccgcgttaaggtgtttgctgcaatattattcgtgagtgcggtaatacccgctcaagcccacaataataaacggcccaataataacccagatacagcattgcaagcagcacaagcacgtatgcataaccgtgatgtgttacttaaaaaagggcgcagccgtaccgctctggtgccgcttacgcctgaacagaaatacagtctcagcgagcaacgtcggcttgaacgtgccgctaaccgtaacatgctggccatgtatcaacgccgtaagcccggacacacgtcaaaagacccgcgtgaggaattgcggttcggcgaacacattagccaacggctgcacgcctcgctgacaaacgtgcttagtcgcctgcacgagcagattggcaaaccttatgtatggggcggacaaagccctgcgcaaggctttgattgcagtggcctggtattttttgccttttcgccggtgctcaatcgcacattaccccgtaccgcagatggcctgtatcaggaccggaccttacatcaggttgaaccgcataaattacgcactggcgatttggttttttttaatattaatcagcgtccgggagccgatcacgtaggcgtttacctcggtgatgacaagtttattgaagcgccacggcatggtctgaatattcgcatcagccagctttctaatgccttctggcaggcacgttttcttggggcgcgacggattttaacggaagaggcgattctgtaacgctgccgcttatgcttaaaacgcgacgctgtaatctgacagctttattatgaaattgattgagaacaaaccatgacacagacacacatgaaactcgccattgacgatgggtcaactaacgtaaaaattagctggattgacaacggtattctgaaaacggtggtttcacctaactccttccgcaaagactggaaaagtgcggcgttacttcgtggtcagaccgtttataactataccattggcaccacaaaatatacttatgacgcgacgtcagataaagcgctgtcaaccacgcatattgactatcaatatgacgatctgaatttactggctgtacatcatgccctgctgcagaccggtatcacaccctgtgacgtcaccgtcattgtcacgctgcccatcacccagttttataaaccggatgactgtcagcgcaatgaagagtgcatagaagcaaaacggcgtaacctcatgcgtgatatctcgctgaataaaggtgaattatttcgcattgtagatgttgaagttatgccggaaagtttgcccgctgcgctgtcgcacttattgaattctgatgttaatgagtttacgaaatctttggtgattgactgcggtggtaccaccctggatatgggaatagtgatcggtgagtttgacgatgtttctgcgatatacgggaacaatgaaattggcgtggcgatggtcacagatgcaacccgtaaactactggctgcggcagacagtgattcaagctacctggtggcaaatgaactgataaaacgtcgccatgacagtcatttcgtcgccagtgtcatcaatgatgattcgcgtattgattcgattctggaaaaaatcgaaattaaaattcaagagctcggtgatcaggttgcctatgaagcgaagaaatttgccaaaaaccccaaccgggtttatttagtcggtggcggggcgcatttggttgaaggcgctgttcgtcaggcgtatctctcgctcggcgatcgtgtggttactatcgaaaatccgcagagtgcattgtctcgtgaaatctgcctgtatcactctggggccggagccacctcggttgaagagcccgtaatggctgaggtggatgataatgcgtaagggacagatacgccgcgtcaatctgtccctttatctgacgccagaacagtcccgtgccgatttgcgcgcaatgcaacaattagagcagtggcatcgatcgctgaatcacactgatgatattgatgacgcgaatatggaaatccggtcatttcatcggagtatctatctggcggggctgcagctccaccagatggaaccggcattatgtcgtcatatcgccgaatcggttggacgagaacatcttacgctgacagcgctaatgcaagaactggtcgagcagaagttgctgcctctgcaacttcccgctccacagcctgaaacatctggcgagcagctcgataagattttacaagaggtggcggtactcaaaacgttgctggaacaacaaaagttggccatgcagcagctacgcttgacgacgaaaccgtctaacaatcaggaaggccctagagcgcctacaacgcaagaagttgagctggacaagtttgatgcccccacagagaaaatgcagaagatacggcagaaaggcattttctaaaaacaagaatgactgttatatattgtgatttggagcggtagcagtatcgtccatcgactgttatcgttcttttttgcacgcacgccgctgacccgcacagttatagaaaaagcttacttcgggttattattttttttcgccatatttacgcaaaatagtccaggggagaagatatatatgcttattttgcgaccgtccgttttcatgtgaaaagggttgctaaccaccttgtcaaatcgctatttaaaaatagccatctctttgttaattcagcaataaataacttcacagttcgttaagccttacactttcagtccacaacctgatatacactcgggagtcggttatcttaactttcacgacagacgtgaggaggagggatacgtttttttggcaaaaaacgcgtagagcagtcttcacttcgaagcacaatacagagaactcgttaacattcacccagtaacgcattctgttgactatggaaatgctaaatatgaatgatatatcagtagcaataaccccccaaccagctcagaatagtaattatatcattgaggagttaatccgtttcataccgtctcaatgtctcctttgcctgaaggacagtccggaggcaaacgttcccctaacacctgcgtgtaatcaacttcttgaactctttttaaataatcagggcgtcgtcctctcgcgggaggtcatactggattacttctggaagaatgccggcacaacgccttcttcaaacagtataaactcttatgtgtcagccatacgaagaggatttgtttctctgggattgtcacaggaggtcatcacaacagtatacaaagtcggttttgtcgttaatccggatttactcatttctatcgagaaaaatgaggccgttgccgtaccttcagtgatgccgaaagttaatactgaaacggtttataaatcacagtcaaagcaatggattttttacctgctgatgcttatttcaggggggctggcaacattatcgatgtttcttagcgaacccaaccttatctatccacaatacctggcaaccattggaaaatgtcaggtgagttttctgccggtttatccggatcatcatgcttaccctaatcaagagactgtcggcgaaatcattaagacgagcggtttcacctgttcagaaggtgatgaaattatgttttatgctgaccgaaatattcatgctggagacattggcaacgtctttgttgcctattgccggaaagtatccaaagggaatgagtcatgtcagaacgcgacataccttaactggaggtcaacgaaatgacagccaataaaaaaattttaaaattgggagcgttgtttttatctgtatgtcttcttgcatatgcattctataactatcatcaacataaaaaatacacttacaactttgcctgctcaggaaacgttcttcaaaaaaatgagctaagcaatgaggtcatcagcgtcagcgtggtcttctctatggctgaaaattcgcatggcgtcatttcattagacggtttttatcgctcgaacaataaggaatacgtcgtccgacgaacacttaactttacatattcgcattttagttcctcgctatacaaactctctgataaagagcttattgtggggaaccgggatacggtacccaatgacttactcattacgaatttttcctatgttaagataaaccggatatccaaaattgatagtgcattccttatcggaacgcatatcatccctgcttttatttgcaagacgggttaacgttctgtagcggactcagaaggacgtaagacgactccactgcgccacttgtacgctaaacctgaatgggcttggcgttttttttactaaaaatccacattagaaaaaaatcattcttttttttcaccttaactcacgttctgcatcccgccctggcgttttttttacgcgctctgcttgtattccttctcaattttcattcatcaacttacccaaaataacgttgaacaaatcaacgcgcgataattagtatcgtaattttttataaaaatagcacaatatatcgtaaaatggcgtttatcaatactatgttgcggcaatttgccgtgctgagtaagattttattcgccacctgatcttgtgatgaggggctgggaataaacaaatgctcatataaagcgttactcaggttttattttttatgacttttgctgttcacaccatctgttaaacagggcctcacgagcgtgggctaacagcgtttaacgggtttgtaatggcatgaatttttaatcacccggtagcccgatatccatgctacccatcagagataaaagagtagggagttcgaaccaacatgttaaaagaaatcaccacaactgctgctgtattaatgttgctgtctggtatggcaaatgccggcactaaaacagccaatatggacgtgacgctgactgtagaggaatcctgtgtactgacggtcgatcctctggaatttggtaaccacgttattgttgatgaaaatattaaggctaatacgaaagcacatgtgacctgtacgactggcacgccctatttgctaacgtcagatgttactcatagctatgaattaaaaaatacgtcagaccccgatgcgcacccagttaaatatgccttgtatttagatgcagccatgacgcaggaactcgctcaggcggcgcctgatgaagccgccgttgcgggctcgtccaatattggcaatggcgaggctcagtctgtcgatatttatggcgcactcctggacaccgaactccacgatgtttcagcgggcgaatacagcgataccgtcatgctacagctcacttattaacagtaacagaggccgtatatgaaacctttactcttttccgctctgtgtattttaaccggatggacgcatatcactggttcatatgcggccagtttgcaaatgtatccgtcaacggtaaatttttgcaatcaggaacgagcaagacctgtttatatcagaaacacgggggcatccccaattagtacgcaaatacgtctttataaatggcagcaaatagataacaaagatgtgttaacgccagcgagtgatgtcatcagcagtcctcccatggctaaaattcctgcggggaaggaacaactgatccgcatcatcattccaaaagaaaaaaaagcaggaacctatcggttaattgttgatgagttacctgacagaacttcatcagatagtcgctcgaacgttaattttttgttgagatattccgtgcctgtttttacctcttgtaaaactgtcaaaattgataaagcaaaaattaccgcttcgatcagcaaaagaaataaccttaattaccttgtcattaaaaatagtggttccgaaagtattaagctaagcaatgtctctcttgcttcaggtcatgaccagcgtgtagttaatcggggattgatgggttatgttttgcccgcgagtgaaatgtcctggaaactacctaatgggctaaataacagtgtgaaattaattgcaaatatcaatgatgaatccacttttaccacgattgacattaaaaagtaagacgctattaatcgcgcttttactcagcgctgacgttgtcagcgctgcgaccaatgccgagtcactctatctcagcgtcagtgttaatggttttcccattgacggttattatgaggtgattaagcaaaatgaaaagctgagtattatggcgatcgatgctgaaaaactcaatgtccgtatggatgatatgccagcatctggcgactatattgaactgaaaccggtgaacgggtttagttatatttatgatgatcttaatcagacgctgttgattaccgcagatccgtcgcggttgaaaaacaaacaaaatataaaaacgaacagcgatgcgcgttttctgagtgcagaccagtattcaccttcggtaaatggtgcggctgtaaattatagtctttttgccagccgtaacgaaggtaatgaacagttcaccgcattctctgagttacgaacctttggaatgggagagggcacattttcgtcttcgttcaacagtaagttttatcaaaagaacagactgagcaataaatccggtacaacaaggctgatgactaactggcgaagagatgatgtggaaaaattgctctcctttacattaggtgacagctataccgccaggaattcgtggagcaacagtgtccgttttggtggtatcagtattgcccataactatacgatgcagccaggtgtgaacaccacgtcaagggacattttaacggattccgttgcgatgccttcaacggtggatctctatattcagggaatcaaaacagcatcccaacaggtctcgccaggccagttcacgctgaatactgcaccgattctctcgggcaacagcagcgcacaggtggtgattaccgatattaatggtcagcagcgaatggtcaatcttgacctgtatggcaccaacaaacttctgactcgcggcttaaacctttgggaagcgaatgttggttgggttcgtaaagattacggttcacgttcgttcagttatcaaagtgaatttatcggcgttgctgactggcgttctggcgtcactaatcagctgacaatggaatctcacactgaacagggccaacatttaaacaatatcggcacaggaatgaactatctgctttctccttcgatggggattatgcatgctgaccttgcatggggacgttaccagcaggacagcggtattcaatggggagcaggttggcaatggaataatcgttatttgagtgtgggtcttaatcatactcaaagaggcaagcagtatcgcgatattacagccctggcaaataatattttgcccaggcaacaagatagtgcctttgttaacctgagtattccttatgtaggcagtctgggcaccagctggatcaggcaggcttattcgcaacaaacttctgaatacgtcggtttaacatggtccaaatctttttccgaaagtggaacgattaccgccactttctcacagtcgttaaataatgagcgggataagacgttctatttaggctattcattaccgttatttagcaaccgaaactatctgagcctcaggcataacgccggttctcatagccgtaataatcagttgagcctgagtcgctcgctggaatcaaaccagccaggttggggatggaatgcctctgcccgtagcggaaaaatgtcgagtcaacatgccagcttacagcgtcgtaacagctggagtgatatggccctgggaaccaaccaatatcctaatcagcacgaatactacgcttccatgtccggatcggtaggcttttttatgggaagcctgtatgccacccgagaattaggtgaggctttcttattagttgatacgaatggacagcccaacgtgccggtacagcttgatcatcgtccggcagggaaaacagacagccgtgggcgattattcctgacaaacctggtgccaaatcatcccaatagtatcgacatcgatattctggatttaccggaagactatcgggctgcctatacccgtcaggtggctattcccagaagcaaaagtggtgtcttcacaaaattcgatgtctaccagacgcgcgcactattactgtcagtttttgcatctgatggcagtgtgatacctgctgctgcagaggttcaggtacgtgataaagatggaaagaccccgactcatggaacccttaatactattgtcggttacgagggtgaggtttacctggaagatccaccgccagggggatatgcagaaattaactgggcaggcgaaaaatgcaagatgacgttgccagcgtcagacgcgcttaataaaacctctatccggagcaagatcacatgtcaataaaaaaaacaggtttaatcctactatcggtatgcatttttttgggcgttttcagcgccaaaagccatgcggcttcctgttggagtatgaacccagcgcattttgcatttggtgatgttaccagtggagaagcagctcagaccaatgcaacgctcgaataccaatgtaatgattacgatcccgacgctgaatatatacggctttgccttgcgttaacctcaggcgggccactggaattgaacactaaccctgccagtacgccgctacagtttatggtttattcagcagatgatcccaacacagatttggatacgggatatgcagaaaaaataattcaccttgctgcgaatgaaggtaacggttcccattattttgaactcctggcaaaaataccggcaggtcagaccggactcaaagcaggcgattatcataactacggggttaacctgaccttaaagtatgcctatcattcgactttagcaggattgccggcctgctcatcggttaccgataacggtgtggcagactcgtttgacgtcaccgcgaatgtcaaagaaggatgtgaactggtgagtgtagatcctatcgcgtttggcagaaaaaacccggcggcaaacgataagctttcaggtaatgccacgggtaatatcacggtacgctgtccggtcaacagtagctttactgttggactgggagccggtcaacataatgacggtaatagccggcgtatgtgcaatggcgctgattgtgtggtgtatgaactctatcaggattcaggacatagtcttgcgtggaatgatagtgatatgaaaaaaacggaactttcagcgacagggaataatatgtcattaacggtgtatggaaacataccgtcgcaagagtgggtaaaagcaggggactataaggatacggttatcgtgaccttaacctattaaagaaaagtgcacgttaagaaagtaaaaacagataatgtcggcatattaatactgccctgtaaattgcttcgatctaaaaagagacagtaatgatgacctacaaatattatccgtcaactggcgtagttgagaatatatccaaagataaaacgtatattttgggtgaatacgaatcaaaattgcttgccgttatgctgagtcaacccggccattatttttccaaagagcaactgattaaaaaggcatgggcaaaaagatgtgtttcgtccggcagtttgactaaggcaattcataccttacgctatgtttttcaggacaaacagccatggaaaattatcatgaccgtgccgggatatggtttttatatagatatggaatcagcttcacatgttcatatcgccaatgagtaagtgacggcttgttcggccgtatgaatagaggttttgtagttattttctactaattgtaagttttatgttatatgccatctcattgcacatgccataaaacaatcaatttttaactatgttttaaagacatctacgtagtaacataatttaatcatgggcttagtgtgtttatctgctaaattaacttgcataaattattttttaagagaaaatttcctgaggtttttatgacgtgaattaataatttaattcagcataattttaacaataatcacaggagtgctacgtgtgcagaaaccagacagtaatagcatgttaacgttgtggtttctgcggagtcttcaggagagtaatccttccgaataagtgacagcacagggtaaagattaaatagcttaattgtaaaaaagaggttgttatggaaatgcaatttaaaagggagtcctttctgaacgcgaacgtaggtgtagaaaaaaaatacaatcagttaagtgccgtgtgcggactaaagctagaacccctgattaatctaagagatggctcaatagtgggttatgaagtgctgagtgtattaacggatgggacaagcgctgaaaagtggtttgccttacagaaaccttcgcatctgatgtctttgttaaaacttcagcttgcatgtataaaaaagctttctcttccggatgagttgaaattattatttaacatctccattgaaagtttgctggggatgaacatcaaagacctcaattatttctcacaattcaaaggcgtttcgttcgagatttcaaacgcaagtaacattaagcgtttaacgaatgaagtaagggtggttttgtttcgtcgtatagatgaattgcgaaaattaaattttgaggtgtggtttgatgatttttacatcgatgatttgattatcctcaacgttatcatgggccacatagatggtgtgaaaattgacagaagagagctgcataaaccctggctaaaagaagaaataagaattctgcggaaaaccctaaccaatattcccgtaatcattgaaggtattgagagtgaagaagatctctctttggtatcaaaccaagacgttctgtttgcacaaggctacctttggaaggaaaaaattataaagtgcacccgattccaacatgaataattttttaattaacgctgagcgccagcttgtctgcttcctgtgatgggttattgcattaacgacaatggaaaaagctattttttagcgacgtcgcgtgaagagatataattgcacttattttacttctcctgacagaaggcttgctgggcctgttcagactcgcttttcgcctggcaccgcactctcaaagagagcgtcatgtggacggcttttatgtgcgtaaaatgaattcatattatctgatatttttctcctgtttaaatggttaactcttgccgtcgggttttaaatggaaatacttatgccctcagaaaacaaacaactatcttttaatatccctatagttactggtatatcagggttgcttttttgtagtgttattgttgcagtcacgctcattttcttacaaaaaaagagtcttattggagataatcataaaagaaacagcgatgtcacttacaatttaacgcttaattatacgggtgttgcactgcgtgaggcggaaaacttcctgacgcaatcggcgcgttattatgcacaaaaagacacgcttagtagagcaatcaaaaatgaaaataaccagggtatgatccagttaatgcagctactgaagctgttgccatcggtatcatccattactttagttgatacggacggggaatatatacatgtcccagaagcaggcgaatgtataaaactatcatcaaagacatcaccatggttaacaagaaaagcagacagaaaaacactgagtcaatatacaggtgtttataaagatccgataactaatgagttatctgtgttgctctataagccgattatttctattgatggcaaagacaaaggtacgctcgcgttcaaactggatttatcctatctcagtacatcattgcggcagatgagattacccgtacagggcgcgttgtttgtcatcaacccgcaaggtgatattttaatgaatgccgatacaggcatcatcctggaaaaaagatttaaccacgatcttatggagaaaatctccagagcagaaagccacttctacgataaggccaccatgtcatggtattacactcactccttaaccaatcctgactggattgttgtttacaaagttagtgaaaatgatattaatgaaatgcacactcagtattttattatcatgggattcagcttttgcgtcttgataatgttaattataggttttggtttgtatctaaattatgcatcaagaaatgtccttatcagcattataaatgccatccaaacaggtggagtgaataaaaagccgaaacttgagtcgatgctcggcaaagcaatcgccagctctaaggaaagggaaagtacactgttaaaagaatcggtacatgatgccctgacaagctgtaaaaaccgacgcgcctttgatgctgagatttcccttttgatgtcggaaaagcatccgtttgttttcgccatgattgacattgataattttaaatctatcaatgatacctacggacacctggttggcgatattgttttaagaaatgtcgttcgtgaaggtatgaatgtattgacgactaaaaacatttcaatctatcgctatggtggagaagagttcgcggttatcttcccagatcttaatcccgaggaggcctgcgtactcctgaatgactggcggcgtaacgttgaattacgcacatggcgggaaaagggactgagtgttacttttagtggtggctttggtgaatggcggggagagtcgttagaggatttaatcagcaaggttgataacgcgttatattattcgaaaaggctagggaaaaacagactgacagaaagctaaggataagtgctgcaaaaatgacaattacagagagggagtgagcttgtggtaaatgcttctcatgttaagtatgaatattttttgttggtaaatgctttcacatgtaaatatttagtcaatctaacccctaaattaagcgtgtttttatcctgaatttcagtaatcgccaataactggaaagttatcatttaacaatccgatgcattgagacgctttaaactaaatgagtacaagaaaaatcaggcaatgttattacgaaaggaaaaaagtaatgaatacgctacttacagcaatagaaaatgtccatattgcgcagacggaactgttaacgcgctggcacaacacgctttcaatcctgagacaagaaaatgaattacttcttcagcaagtcgattacctggaaaacaggttggctttgctggaaggtaaattgctggaagaaaggctcaaggtaagccgaagcacgatgctttaagcgcgttaggatgactaccgacgcgatatccaatctgtcagttatgaccagcgtcctgggtcgttaggttgcaaccgcactggcgacgtgatttacgtaaccttgctctaagcaggcataaagggcaagagtaagggaggtcgtcataaggccagggatcgaagcctgagtaaccaaatccttatcatcactcaggatgatatcttttccccttacgcccatgataaaaccggtaaggggagtggattattttttgccgttgcgccgccttgtgatctcgtttagtaaggcgttaatctgcgcatccgcaaacattgcctccagcgagatactgagcttacgccgccagtttggataagcggctaccgtgccgggaacattgaccggtgaggccatgtccagccagtcttcaggttgtaaacccagcagggcgcttgtgctgtccgcaagatagtgatggaccacccgattaagtaaccggctcatctgcggactgtttacctgcacgtacgcgcgctccttcagataaccgtggcgcttcaggctctggaggagcgccagtcgggccgccctgcgctgatgatacagcccggcaagtaccgttttatcaggatacaatcctaactcgctgcccagcgttaaatcatcgcgttgccaccagccgcgcagcgtgggcatgtcatgcgttgtcgcaaccgccatggcctgacgcggccacgccgcaggcgggcggaatcccttgtgcgaggtttgctcaaaatagagcactttatacgagtaaaccccggcattgtggagcttatcgacgatcgcctccggcaccgtgcctaaatcctcgccaatcaccatgcagcgatgacgttggctttccagtgccagaatggccagcaaatcgtcgatcggataggcgacataggcacctgatgcagccgtttcaccttgcggaatccaccatagtcgcagcagagccatgacatgatcgatacgtagcgcgccgcaatcgcgcatgttcgcgcgcagcagcgtaatccagggttcatatgcccggtcatataaaccctgcgggtccattggcggtaatccccagttctgcccgagcgggcccaggatatcaggtggtgcgcccacgctggcgtccaggcaatacagcgcccgctgactccaggtttctgatccgcctgcggcaacgcccaccgcgaggtcgcgataaagtccaggtgccatcggatgctgctgactgtcgtgccaacaggcggaaaattgactcgccgccagccactgcagccacaggtagaaacgaatctcatcgccatgctcaattctgaacgcgtgcacggcggccgtgtccggctgttggtaggccaggggccacgtttgccagccgtggcgcagcggatcttccttgataagccgggcctgcaaggcatcaaacaacccctgatgtagcagactttctccgccctgaaccacaaagtcgtcaaacgccacgacctgactatcgtctttgtcacgctgcataaaccgctgccacgcaaattgcagggcattcagcttaagtgatgccaccgcagcatagtctacccactgtgtgtgacgcgcctgccgcagtgtgttttgcgtatccgcggactgccaccagcgctgcgcggcgtcactcaggttaaagtcctcaacttcgggaacacagatgtagagcacgttaagccagcgccgggaagaggggctgtaggggctggcctgctcgggtaaggcggggaaaagggcatgcagcggattcaagcccacaaaagcaccaccgcgcaggcccacttcattcaccatgtgacgcaagtcggcaaaatcgccgattccccagttttgtgctgaccgtaaagaatagagctgaacacaggtgccccagcatttctcgccgcggcgtaacgcgtccggctcatagcaacgtgacggtgtcactattatctggcatgtcgtgcgctgtgcatccaggatgacggtcaaacgatgataaccttcaggcaaatcaggaagcgctaacggttgtcccggttcaacgtgccccgaccagcgctctcccgcttcgctttccagacaccagcgagccgggccaggcagagagggcgttaacgtgatgggcttgccctgtgtaaaaaccgccaccggcgggatcatttccgaagccgaacccggctgcatagcggccagtaaacgctgacgcgttaacgcagacacctggcggaccgcgccatgtgcatcaatgtagtccgtagctatcctgccgatcccggcaggataatgaagtggtttcatgatgatccttatcgttgacgctgccagatgcgctgttgatagtggcgaatcgcccggtcagcgctgaacataccgcagcgtgcggtgtttaatatcgttgcgcgcgtccaggcggctttatcggcccacagcgcttcaacgcgttgctgggcgtggaggtaatgccggaagtcggccagcaccagataaggatcgccgtttctggcccccaggctatgtatcagcagatcaaaagcatgttggtcacctgcgctgaacgtgccatcttcaagtgaggtcagcgcccggtcgagctgggcatctttttcacgccactgtgcaggtgcgtagccagccgccttgagcgcgttgacctgttccacggtgtgaccaaagataaagatattctcatcgccgacctgttgagaaatttccacgtttgcgccgtcaagcgtgccgatggtcagtgccccgttcagggccagcttcatattgccggtaccggaggcttctttgcctgccagtgaaatctgctctgacaggtctgcggcagggatcagccgttccgcaaccgagacgttatagtcgggaataaagaccactttgagacgatcggccacgcgcggatcgttgttgatgacgtcggcaaccttgttgatggcgaagataatatttttggccagcgcatagcccggtgccgcttttgcaccaaatatcaccacgcgggaacaacagtttgcctgagcatcgctcaccagggtttgccacaaggcgatggtatgcagcaggctgagatgttgacgtttgtactcgtgcagccgctttatctgcacgtcaaacatcgcctcgggattcaccgcaataccggtgcgttgcgcaatccagcgggctaaatccgttttgttttgctgcttaatctcccggtattccgcgcaaaacgcggggttgtccacctggttttccagcccctgaagggcatccagatcgttaagccagggcttattgagcgtttttccgataagcgccgccagccggggattgcactgatgcatccagcggcgcggggtaatgccattggtcacgttatggaatttttcaggccacagggcaacgtattccgggaacagatcttcttttaccagccgtgagtgcagggcggccacgccattcaccgcaaaacagctcaccacgcataaattggccatgcgcagctgtttgttgtgcacgatcgccagttttgaccagaccgtctcgttttccggccagcgcgcatttaccacctctttaagctgggcattaatacggttaataatcgccatatgccttggcagcaggctgcgcacgatggcggtatcccaacattccagggcttccggcatcagcgtgtgattggtataggcaaaggtacgctgggtaatatcccaggcgtcctgccagctgagctgatgctcatccagcaacagccgcatgagttcagggatcgccagcgtaggatgcgtatcattaagctgaataacttcgtgatcggctaaggtgtcaatccggcgtcccgccagacggtgacgacgaaggatgtcagccagcgaacaggcgcactgaaaatactgctgcatcagacgcagttttttccccgccagatgattgtcattgggataaagcactttggtcagtttttcggcatcgataccttgcttttctgcccgtaaaaaatcgccggcgttaaacttctggagatcgaaaggatgcgcatgtttagcctgccacagccgcaggggctgagtgaggccattttcaaagcccacgaccggcagatcccaggcttcgccctccagctgaaacgcaggctgccagcgcaccgaaccctggtcggaaatcactttaccgcctaatcccaccgtaacagtcagtgcagcgttgtgggtaaaccagggataacggtcacgctgccagtcatcgggcatttcgtcctgtgcaccctcaacaaagcgctgacgaaacagaccatattgatagttaagaccatagcccgttgcgggctggcccaccgtggccattgcgtcgagaaaacaggccgccagcctgcccagtccgccattacccagcgccggatcgctctcgcgctccagcacctcactgagcgaaacatcccagcgttttaatgcgtcatttacagcgtcataccaacccagattcagcaggttgttgccggtcaggcgtccggtcagaaactccatggagagatagttcacatggcgctgatccccggatgcaggccgggcgggcagtgcgttcagcatctctgccagcgcaccactcagggcttgccaccactgatgcggggtcatgtcacctgcctcatgcaggccaaaatgctgccactggcgcgtcagcgcagcggtaaaacgggcgtgatcaaaagggtgctgtgtcatagcctggtgtcctgtcgataaagtagaaaagggatgacattcagtctgccctggcgcgcaggcccgctcctcatcccggcaaaggttccgtcaggatgagggcaagggaggagaggataaggcaagcctgaaaatttaacttaagtgtgattagactcgcttttgtgaagatccacttaagcgtccacttgctttatcagaggcgatagctgaacgtgtgaggaataattacgaagcgtaaaaaaatgatgcgccagacgttaacggagaagcgtgcgttcatgttaatcccctcaaaactcagccgtcctgtccgccatgaaaccacggtaaaacgggaccgcctgatacgaaaattatcggctgcgggtaattatcggctggtactggtgaccagtccggcgggctacggcaaaaccacattactgtctcagtgggcagcagataaggccgatttaggctggtattctcttgatgaaagtgacaatcaaacggagcgttttgcagactatctcattgctgcgcttcagcaggccacgcagggcgcttgtagccgcagcgaggcgctggcccacaagcgccagtacgttaacctgaatgcgctctttacccagatctttaacgaactccaggcctggcatcagccgctgtggctgattatcgatgattaccatcacatcacgaatcctgtgattcatgatgcgatgcgtttctttttacgccatcagcccgaaaacattaccctggtggtgctctcacgcaatctgccgcagttaggcatcgccaatctgcgtgttcgcgagcagttgctggagctaagcagtcagcaactggccttcacccatcacgaagcacaacagttttttgatgcccgcctgcctgcgccgctggcctccgacgagacagggcggctgtgtgatgatgtggcgggctgggctaccgcgctgcagcttattgcactgtcggcccggcagggcgcaggcgccgcgcaacactcggcacgtcgcctgtctggtattaacgccagccatttaaccgactatctggtcgaggaagttctggataacgtcagtctgacgacacgccatttcctgcttaaaagttcgctattgcgttcgctcaatgcggcgctgattacccaggtgacaggtgaggataacggtcagcgctggctggaagagattgagcgtcaggggctgtttctgcaacgaatggatgactcgggtcagtggtttagctatcacccgctgtttggcagtttcctgcaacagcgctgtcagtgggaactggcagccgagttgccggcactgcatcgggcggcggcgacaagctggatggcgcagggcttccccagcgaggctatccatcatgcgcgcgcctcgggtgacgcggagatgctgcgggatgtgttaaccgagcacgcgtggtcactgtttaatcagagcgaactgcctttactggagtcctcgctcaatgcgctgccctgggcgatgcgacttgagaatcccagcctggtgctgctgcaggcctggctgatgcaaagccagcaccgtttcgcagaggttaacagcctgctggcccggtttgaacaggagagccagtgtgaaatcgatgcggtgctgcgcggtgagttcaatgcgttacgggcgcaggttgcgattaatgacggcaatgctgatgaggccgaacgtctggcgatgctggcgctggacgccctgcctgaacgtcgccattacagccgtattgtcgccacatccgtgcatggcgaggtcatgcattgcaaaggcgagctgagcaattcgctggatctcatgcgccagacggagcacatggcgcgacggtatgaggcctggcactatgtgctctggagcctgatccagcaaagcgaaatcctgtttgcccagggctttttgcagaccgcctatgaaacccaggagcgcgcctttgtgttggtgaaagagcagcatctttctcacttcccgctgcatgagtttctgctgcgtatccgtgcccagctgatgtgggcctggggcaggctggatgaggccgagcaggccgcacgtgaaggcatgaaggtgttgcagggttatcagcctcagcagcagatccagtgccttggactgttggtgcagagcgcgattgcccggggaaacctggacaacgcccgcaacctgttaaaccggctggaaaacctgcttaacaatggacgctggcacaatgactggctcgccaatgccgataaggtgcgggtgttgtactggcaaatgaccggagacacgcaaagcgccagtgagtggctgcgtcagacacccaaaccggcctgtgccaataaccattttttgcaggggcagtggcgcaacgtcgcgcgggcgcaaattttactggggcattacactcaggccgaagtgattctggatgagctgaatgaaaacgcacgtgccttgcagttaatgagcgatcttaaccgtaatgtactgttgctgaaccatatctactgggaaaccgatcagcgcgccaacgcccagcacgcgctgttggaggcgctcaggctggctcgcagtaccggctttatcagccattttgtcgtccagggcgaacccatggcgcaacagctacgccaggtgctgcagctgaatgcactggatgagctggataaccatcgggcacggcgcatccttaacgagatcaataaataccaccgtcataaatttgcccattttgacgaggggtttgtcagccgcctgctgaatcaccccgacgtgcccgagctgatccgtaccagcccactgacacagcgcgaatggcaggtgttggggctaatctattcgggttacagcaacgagcagattgcggcggagctggaggtggcgtcaaccaccatcaaaacccatatccgtaatctttatcaaaagctggggattacgcatcgggctgaagccatgacccaggcgcagtcgatgctgaaaatgatgggctacgtgtgagaaagacgacaggcagcagcacgctgcctgccagtgccgttatttaacgcgacgtgtatcgggcatcagtaaggtggcaaagcccagcagtggaagaaagccacaggcgttgtacaccgtggtgatgccgtaccagtccgcaaatttccccagcgccgccgccgcaatcccgccaataccaaacatggtgccaaacataatcccggccaccatgccggtgcggcccggcaggacttcctgcgcatataccaccagtgcggcaaaagccgatgaaaagaccagaccaatacagacggtcagcacggcggtccagaacaggttggcatgcggcatcagcagcgagaacgggataacgcccagaaacgagatccagaccactgccttacgaccaatacgatcgccgaccggccctcccaccagggtgccgatcgccacggcggccagaaaggtaaacaggtagatctgagcctgagggatcgggagctgaaaacgctcaaccagatagaaaatgtagtagttactaatagaagcaatgtaggtaaattttgccagcagcagcacaccgaccaccgataacgccagtttcacatctcgcggggacagcgatcgcagtgcctgaccgttatgttttttcatgtgtgcatggccgtgcttaaccgtccagcggctgatgccggaaaggacaatgaccgcaaacagcgcaatcaacatcagccagcccaccgccagctgcccatgaggaataatcagcatcgcggccactaaaggcgcaaaggccgtgccgatatagccaccgacctgaaaggtggactgcgccgtaccaaagtgcccgcccgatgccatgcgtgccacacgggaggcttcagggtgaaaggttgcggaacccacgccgatcagtgccgaagcaagcaacaccacggagaagtgcggggctattgccagcagtccgatgccgaacagggttgccaccatgccagagggcagcagccagggtttaggatgtttgtcggtatacaggccaatccagggctgcaacagcgaggcggtcatctgatagataagcgtaatcaggccaatctgcgcatagctgagggaaaaattggatttcagcaaaggataaatcgacggcagcatggcctggataaaatcgttacagcagtgggaaaccgccaccgcgccaagaatcgacaccagaatcttctggctgtcgtcaacggtcggggccaggcccggcgggtttgattttacgtcgctggagtaatcagacatgaggatttccgtataggcggctttacgtttgttgacgtatcttaccccacgaaaaaacagcggtgctgacaaaagtgctatttatggcaaattagtaaaataattgttaatgctcataatgttttactcaggcaaaccgaggcaggcctgtccacatacacgccatagcggtcggtttcctgataaccctgacgctgataaaacgccacggcccgggtattgatgacgcgggtagaaagccgaatcgctttatatccccgctgccgggcaagttgctctatggctgccagcagcgctgcgccggttcccgcacgctgtcgggtggaaaacatgcgtttcagttcggccgtatcaggggaaacatgcagcaatgcgccgcagccaacagggttatccgcatcatcgctggccagtatccatagcgcatcgtctgagggagtaagtgatgcgtcccgtcgtcgccagtgattgccaacagctcggctgacagacgggccgtcaacgtctgcagcgccggtgtgcatgcggggacgatcctggtatggatcactttgcctggccccaacggctgcgcaggtagttaacggcctgctgggtttgcggctgattcaggtaatcttcccggaacaaaatagtgccatcgatctgcgggatggaatcgttaagatccagttgtctttttagctccggcacaccaccgttaatcgtccactccggctcatttttagccggcacgccaaccttgtataaagcaatgccgatatacaggcgggttttggttggcttcaccacgttagcccaccagtttgccagcacatcatagcgggcggcgctgcgcgagaagggccagtaaatctgcggcgcaatatagtccagcaagccttcctgcacccaacggcgcgtatccgcataggattcatcataagctgccgcaccgcgcgtatccgagcctgccgcatcatgggagcggttacgccagacgccagccgggctgacgccaaattctacattcggcttgagctgcttgatggtgtgagaaacctgttcgattaacaactgcgtattgtgcctgcgccagtccgctttagacgcaaaaccctgaccgtatttgataaaggtctggctgtcattcagggcagaacccggtgattcggcatagaaataatcatcaaactgcacgccatcgatgtcataacgtttgaccacttctgccacgatgctggttatccagtcccgggcatccggaatgccggggtcgagcacatagcgatcccccgaggtacgaatccagtcgcgatgcagcacaaacacgctggctggctgctgtgacagcgtgtggttaagctcagccaccgttgaaggtttggtattcaccgagacgcgataaggattaaaccaggcatgtacccgcataccgcgcctgtgcgcctcatcgagcataaactgcagcggatcgaagcccgggtcctgaccaatctttccggtcatcatgtctgaccagggcaggatttttgatctccacagggccgtgccgtctggtttaacctgaaaaaacacggtattgatgcccaggcttttcagcttatccagcttatcggtcagcgcttttttttgctgactgacgcgcacgttgtcatcgctgatattcacggaggcgatcggtggccagtcaagccgtgaaaccgtcgtcagccagacgccgcgcaccggttcatgatgttgcaccggttgtgaaggcagcgacggtttactgacgggcgggaagggcgtaaccagcgatttaggcggttcagaggcacaactgaccagcagcaaggccgatgcggctaacaggccagtttttaccaccgcgttgaagcggaacaggtcgcgaaaggtgatgatgataaactccgtgtagcgcagtccttgatgcaggctattctgatcctatttgccgcaaagtcaatcagccctgccagcatcaggtcacgcagtttgccttacccggcggctatactttttatgctaatgcgtaacctgagcaaaggagcgataaatgaaaacatgtaaaggcaataaacagtcattgccggttcgctattgcaaacagtgccagaaaccgatgacctggcgcaaaaagtgggagaaatgctgggaagaggtgcaatattgctcagagcgctgccgaagacaacggtgagggaatgcgctgcaagcctgatcaggacacataatcggcctgttattcaccctaaacgtagcgatgtaacatttagcaaaggttatcctgacatttacatcactgttcccacgcaccatcgcaattactgtaccaggcttaatgaaaagcgaataacagtgattgtggagcaatatgaaagagcaagagagtacatcgggcattcattcctatgatggtgccgcaggcggctggggcgccctgaaagcggtggctggcgccattcgtggacagatggcggtcaagcaggacgtcatcgcgttgttcaaggtcaaccagcccgaagggtttgactgtccgggctgcgcctggcccgatcccaagcacacctcctcgtttgaattctgtgaaaacggcgcaaaagcggtttcatgggaagccaccagcaaacgcaccacacctgaattctttgctgcgaataccgtcagcgaactttggcagcgcaacgcccatgagcttgaaggcgagggcaggctgacgcatccgatgaagtacgatcccgccagcgatacctatcagcccattgaatgggagacggcctttaaggaaattggcgagcggctgcgcagctataaggatccggacagcgtggaattttacacctcgggtcgcgcctccaacgaagccgcgtttctctggcaactgtttgcccgtgaattcggaaccaacaactttcctgactgttccaacatgtgccacgagccgaccagcgttggcttgcctgaatcgattggcataggcaaaggcacggtggaactggatgattttgaccattgtgatttggtgatctgcattggccataaccccggcaccaaccatccacgtatgctggcaaccctacaggaagtggcaaagcgcggagccagaattgtggcgatcaacccgctacgcgagcgcgggctggaacgttttaccgcaccacaaagcccggttcagatgctgacgctgagctcaacagaactggcctcgacctactacaaaattcgggtaggcggcgatgccgcgatgctgaaaggcgtgatgaaatgcctgctagcgatggatgaggacgccagagcgaaaggcaatccgggcatcttcgatctcgcctttattgaagaacatacccagggcattgacgcgttgaaagccgatttggcggcgacagactgggagcacatcctgaaaatctcgggtatggagcgtgagcaaattcagcacattgcccacctttatgccaatgctgaacgcacaatcatttgctacggcatggggattacccagcatcaatacggcacgcaaaatgttcagcagattgccaatctgctgctgttgcgcggcaatatgggcaagaagggcgcagggatctgccctttgcgcggtcactcaaacgtgcagggcgatcgtaccgtgggtatcactgagattcccacagaaagcctgctgaacagcattgaaaaagtgtttggttttaaacccccagccaaacacggccacggcgcagttcaggccgtgcaggcgattcgcgatggaaaaatcaatgccctgctttgcctgggcggtaacctggccgaagccatgtccgacccgcaggagacgttccctgccatgcgcaagctggatttagtggtgcacatggccaccaaactgaatcgttctcatttgttgctggcaaaacacagctatctgttcccggtgttgggacgtacagagattgaccagcaacaatccggtgcgcagagcgtaaccgttgaagattccatgtcgatggttcacgcctctcgcggtacgcttgaacccgcctcaccgcatctgaaatccgagccagcgctggtagccggtctggcaaaagccacgctgccgggcactgtagtggactgggacagcatgatcgctgactacagcaccatccgtaacgccattgagaaggtggtgccaggcttcgacaactttaatgagcgtctccagcagccgggcggttttcgtttacctaatggcgcatcggaacgcgtctggcatacgccgtcaggtaaagcacaattcctgctcatggacggcatcaacgaagatccgcgatcgttcaaatgccatgatttggtgctgaccacgctacgcagtcacgaccagtacaacaccacgctttacggcctggacgaccgctatcgcggtatcaaaggacgccgggatgtgttgtttatcagtgaaaatgaggcggagaaaaacggggttcgcatgggcgatcaggtcaacatcattgcgctggacccggacggtaaacctacccatcgtcgactcgataatctgaccatcgcggtccatgacatggccgacggctctgtcgcagcctattatcccgaggccaatgtgctgatcccactggacagttacgacacaaagagcggtattccctcctataaaagcaccccggtgatgatggaacccgcccggtcagaagtaccagcggacgcggcgaccctgcgctaattgctttctgctggcataaaccaaaccttaacgaacagccatctgagtggaaatctctgctcagatggctatacaatcgccgcgaattttactcatgaggcaatcaaccttggacaaaagtcccgaacgattacacctggcttctgcagtaagatagtcttctggctgtcttaactgcgcgttaagatggcggttttacaatcatccctccacaacgtgatgcgctctgtgcatcagcgcctgctgtaatccattttattcatctttacttttccgtcctgcgcatactgcgtggcggagagaggtttatcatggactggaaaatctttttactgcgcgtgtcggctgcgctgattctgggtgcgctcatcggcagcgaacgtcaactgcgtcaacgcatgaccggcttacgcaccaacgcgctggtcagcaccggcgcctgcctgtttgtgctgatgacccaatgtgtaccgggcattgccaccgacgccacgcgcgttgccgcctatgtggtttccggcatcggctttctcggcggtggcgtgattatgcgcgacgggttaaatgtgcgcggcctgaataccgccgccactttatggtgtactgcggccgtcggcgtattgtgcagcatggggttattgctcgaagcggcgattggctgcatggtgattctgtgcgccaatatcctgctgcgcgagctggcgctgggcatcaatcgtcagtcgatcgtgtcggctgacgaggcggtacagcattataaagtgcaaatcgtttgtctggctcaggatgaagttcaggtgcgcagcctgatgctgcacagcctgggcaacagcggcttgcgcctgcagtcgctccacagtgaagatctggacccgccgcaccgcatggaagtgaatgccgaagtgatggggcagcccagcatgaccgggcagctggaaagtctggtaagccgtatcagcctggagaagggtgtcagttcagtgcgctggcaggtgtgcgggcttgatcccggtgaaaacgggtagggaaaaaacaagcagcgctacgtgaattctgaacgatgagcaggagagcgacccagtcagattaaacgtagcgttattatttgggttcaataaaatctgttttcagaaggggggttttacgctatataactatgacctgatgctcaaagtgtaaggttaggtaaagcggagctttgatatttctataggcgaatgaataggttataaagctattaactttgctggcctcttatctttactgtgcggatcactcgatgaagcgtagaacatctttctttttactttccggccttatattgctgatgtccggctgcagtcatcatcctcgctcagacgctcccgaggacacttccgcatcggattcaacgcaaaaccctgacttaatcccgattgttgctgcattgcatgaccaaatgcatacctggcatgacacaccgtaccaatggggcggaacgcaactgtcgggcgtcgactgttcgggctacgtctggcgcaccttgcatgaccgctttaatctgccgatggatcgcgtgactaccgccgatctcctgcatatgggcgttcgcgtcacgccggaacatttgcagccgggcgatttggtctttttccgcatcggcggtggtatgcatgtcggattctacgatactgaccatcagtttattcatgcctctgccagcaaaggcgtgattcgttcttcactcgataatccgtactggaaatccgtttactatcagtctcgccgtctgacacgtgaatatggcgcacaggtgacgctgaatcgggcaagttaatgcgttgaacacaggcgttctgcccgagtaaaacgtgaatggggagatcagccacgcgtctcacgacagaatggtggcttatctccgctcaccccaacctcaatgtgccatgtgttgcagccacgcttaacggggcgacgcagccgttatgtagcaggttggagtttctattggttactgtaaaggcgcgcgttacgcctgcggctccacagatgccttcgtttgcaacgcgttatttaatggtttgtcgtgatgcccattgttcgggcgtcaacgtttttacatcaaactgatcgcgcgtccggcaataagtattcccccccatacgaccaatcgcgtccataaggtgctgatcgatgtgcaggttttccgggttaaccgcatcgctacgcacatagacgccgaccacttcaccaagaataatttcgcgcgcggggccaacctgcaaagtggtatgtcggcggcattccagcgcggccggcgcggcgagaatgcgcgggctgcataccttgttgcccggaacggtagccaggccagcttcacgcagttcatccacctctggcgcaaatttaatcgcgcaaacttccatttgttcgaccagcgcctggtccacaatatgcacggtaaattcgcccgtttcacgaatgttccgggctgtgtctttaaagcgcatatcggcataattttcgacaccgatagcaacaatggccggatcgtgagttaacacgttgaagaagctaaacggcccggcattcgcgtgcccgtttttatcaacggtagtcaccagggctacggggcgcggtatcaccgtaccaatcagtattttgtagcgttcccgttcgcctaatgacgcgaaatcaaaccaggtgtgcgaattcatatcaaactccggctgcaatacggtgggtttcaagcggcgtatggcggctaaggttttcgaagccgtcctgggtcaccacataacaatccccaatgttgcaaccggccgataacggctcaagccattgggtgtgcaacacaaacaccataccttcctccagacgatcgtaattgtgagacgaaatgttgaagctgttttgcccgcccgccatgccgactgaatggcccaggttcgggttatgtgggccatgagtggcagggtaaacatgcatgagtttgcgtccctgtgcttcccagtctgcatccgggacatactgttgcggaattaaacgtgcttcgccgtccggcatgggtgaccagttatacggcatgctgcgggcttcgggtgaggtcaacagtccttgcgcgatcatgggcgcaaaggctgcattgttgatatcgcgcattaacgcgcccggcttaatgcgttgctccgcacgtttaacgccttcagtacaggcgtttaacaccagctcctggcgggcggtgatatcgcccacggcaatcatgcgcgccgtctgggcggtatagccgcgccaggtgacatttgagatatacaaattgatcaggtcaccggggcgaacaatatgtccgtaaggtttaccgcagtgcgtaccaaacgcattgataccaatttgatagccatcgccggtctcaccaccgaatgccatttgcgcggcggtaaaggccgcaaagatttcatgatcggtgatacccggtttcgccacatggtaagccgcttgcgtaccgatgctaatcaactgtgccgccgccctgaacatttcgatttcacgcgcggagcgcactttttgcagtcggtccagaatggcgttgtctgcaatccattgactgccgggtaactggatttccagcgacgcccagaaagtcaggctggtacgatcgccaattttgccaatctgcgcacgcgctaatcccaactgacgcagtatcgcggcacatttttcggccgttttcaccaccgcgtcgccgggacggtcagcatattcgcggcctattggcccaatctgccagatgtcctcgaccaacagcggctctccagctggcggaagcagcactgactgggtgaaaaatgagagcagcgtcaagggcttattgttatctgtggggatgatcagcacaccttcgcgcatccagtcgcagatatagcgaagatagggatttgacgcatgaaaccagcccacgctgcctgcgtgaacgatcagcgcatcgtgtccggcctctacggcctgacgacggattttacgcagacgctcttcaaactcctccagcggcaagggcggcggggcggaaaacgtgaagtcaggctggaaatcagccaataacgcgccgatgcgatatcctgcggcggcggtcgcatgagtagtcatagtgaatcctttttatttacgggttttgcggacgcggtgccagtacacggcgcgcgaccaacatgcccatcaaggttatcgcaatcagaatgccggagatggccgcaacgcgaacatccagcgactcttcaatcagtgcaaacatgcgcaggggaaggactgtggtgcgtgcgtcggcaaggaacagcgtgaccgtaacgttatccagagactggataaacaccagaaacgccccggcggtgatgcccggcatcagcagcggcaaggtgacgcggcgcagggtcataaaccagctcgctcccattaccgtcgaggcttcagccagagagggattcattccctgcgcaaccacggatgctgcccgatacatcagcgggccgaacaccacgatgtggcccgtaaccgttaaccatagtgacggtgtcacgccaaaaaagttggcaacgattaaggccgccaggccgtagaccaggctgggcagcaccagcggtgccagcagtaatggttcaatggcattgacgcttttacgtttcattcgcgtcatgccaatggttgcgggcacggcgaacagcagcgatcccaacaccgccaacccggcaattttcagggagttccaggccgcgatctgctccgttccggaacgaacggggtccagtaaggcctcgtaccagcgcagggaaaatccttcgggcggatacttcagtgtttgaccggcggtaaacgacatcatgatggcaataacaatgggcgcaaccagatagataacgcaaagcgtgccaaagccatagacgaacaggttatacagtgcagcaggcaccgggttttctcgatgattacgcatggccgctcagtctccggtggcgtgaaatcatggtcagggcaaccagcaggcagccagtagaaagcagcagcaccacggcgatggcagaggccaatggccagtcaaacagcgtgccgacttcgcgataaatcagctgtggaacatacacattgcgcgcgccaccgatcacggactgggtgacaaacgaactactggtgctggcgaacaccagaatccagccggccagtaagcccgggagcattaagggcagcagtacggtgacgaaaattcgccacggacctgcacctgaaacctgcgcggcttccgtgagtgtgtagggagtccgcgtcagaatcgcaatcaacggcaggataattaacggcagatcgatctggcacattgccaggaccagacccagctcggtaaacatcaggctggttggcatgccggtgatgcccagcgccataagggcatcactgacagggccctggcgtcccagaatgacaatccaggcaaaggttcgcaccacgttgctggtcagcatcggtatcagcgtcaggaaaatgatcgtctgacgcactgtgcgaccgctgtgccaatacagcagagcgatgggaatccccagcaaagtcgtgccaataacggtttcaatgcccagtcttgcggtattaagcagcacgcggaagttaaacgcatcgccaaaaaagcgagcgtaatgctcaagtgtgataccgcttttggtgataaagctgaatccgactaaaacagcgagcggcgttgcgaaaaacaccacggacagcagcaacatgggcaccacatacggaaagccgctctgtttcatcacgccaccttatccagcaacaatcgtatcgaatttgcgtatccaggcatcgcgatttttgttgatcgcggcccagtcgggataaaccagcgaaggcaggtcctggcgagtaacgtaggccgagatggcaggcgtcagcgccacattgttgttggtgggaaacatttctgctggcggtagcttgaactgatcctgagcggcctgtgagatagcggcatccatataggcataaaccgcctctgtgtttttactgcctttggtcaggtgaatgttgaccggtgccgccggtgtgccggttttaggatgcacaaattcggcattcatgcccaggctcttcagacgcgcgacgttactggtgctgcacatgaataccgcaatttcaccttgctggaacagcgtcatctggtgattggtgctgtcgacgatgctctttagctgctcaggatgtttctggaacagttgaaacacggcatccatatcatctggccctttgccgtatattttggcaatttcggtataggccatgacggcggtgttggagccaaaccctgtccaggagaccagccctttaaacctgggattctcaaacagatcggcatagccatccggcctcggtaccatatcgggattgtaggcaatgccgttgacttccacggtcaccgtcggcccgtattctccctgaaaacttttatcgagcaggtgccagtttttcagccgtgaaggatcgattttttcaatcaaattattttgcagagcaacgtcagtttgccccggagacatcagcagtgcgtcatagggcggattgcccgggctggccatcactttcgcgagctggtcctgggccatcgctggcgcaatcgtcaggccaatgccttctttctgcagcatcggtgttaataccgtgcgataagcgtcctcccagttgccagggaaggtggctaccacggctgattgcgtattggctgccaatgcccgtaacgaaagcggcagcagtgaggctgccgtcgccccggcaatcagttgaccgaaccgacgacgactgatgttaacgtctttcatagtttttccttcttatgcgctcaggattgtggttctgccggaaaggcatggcagcgtgtggtattgatctcggcgaacaactgcgcgccggggcgaagaagcggggtaccggcaccacgcacttcagacgcgcgcaggctgccaccacagggaagcgtcatctcgtggagcaacgtcgggcccaaaggaactgacacgctcagcgtaaccggctgcgtgttttcgttggggtgcgacatcagggtgatgtcttctggtcggcaggtgatgatgaccttagcgcccagaataaagttgagtcgcctgggcaaccgcagcgtcatatcgtcaggcaggccaattaaggtggtatcgttgtcaaagcgcaacaccgtgcccggcaattggttggtttgaccaataaaggtgttaacaaacagcgtgctgggctggtcatagaccgccatcggcgtatcaatctgctcgacgttccccttgttcatgagcactaaccggttcgccaggctctgggcttcctcttgatcgtgcgtgacgatcagcgtggtgatacccaacgttttttgcaggtgcagcaactcaacctggagatcaaaccgcagggcgcggtcgagcgcaccaaagggttcatcaagtaataataaagaagggcggccggcaatggcgcgggcaacagcaacacgctgctgctgtccgcctgataattcgcgcggcaggcgattgccgtactcttccagccgcacaagcgtcagcatctctttcacacgcgctttgcgctcagcgcgcgacatctgctgacaggacaagggataggcgatgttctcagccacggtcagatgcgggaacaaagcgtagttctgaaacaccatgccaataccacgggagcgcgctgacatttgcgcaaggtcctgatgacctaacacgattttgcctgctttgggttgaatcagtccggcaatggcgcgcaagacggtcgatttaccgcacccgctcggcccaagcagcgccacaatttcacccggctcaatggtgaacgaaatatcactgatagcattactgctgccgtaactgtgggtaagtccatgaacgctaagacgtttacgttctgatgttttaggcatagttgacatagtgcttccctggtacggcatcgtttaatggaacgatcaagtcgatgtgaggaattttgcaagtggcgtgccagcctgaaatacagggggaggcgaaaaagcacaatacgttgattattaatgtaaattattttcattaacttattcgtatatatttgcgaatatctttgattcaatttttattcatacataatcgatcagcattcacttttatagtgcgaaacttccttaatttggtgcagcctgatgtcattttatgccaccgccgcagcagggcttgttaacggcaaaggcggtaatcgcgcgagaatgcaggctgtgcaagggattgagagaagagtaacgaaaaaaattccgtacagaattaatcggaaaataattcgcaaaaatatgcgaatgtttttaatttactttttagttatttgcatcagggggttagccatagctgttccttgagtggcatgaggcttgcacgcaacagcctacaatgacatctaaagggttcgtctatgagattgggaattgatgggttaaagctgccggaggcaaaaaaacgaggtccgctcgccagcctggatcatgtgaaggatctggggctgagtggcatttttttcagcacgctgctggatatgagcccacagctcgatatcgctgaactgcgagacatccggcaaaaggctgatgatttaggcctttacctcgaaagtggattaggcaaaattaatccctattgcagcgctgaatcacccgaattacgtgacattggcgacggcgatatcatcgcagggttaacgcggatgattgaatcgggggcagaaattggctgccgagagctttgggtgtcacctggcaatttcaaaccggcttatcgcggtcggctggcggtcgatcgctttcgtacagatgtcacctgggatgagcagcttagcgccacagaaaaagtgctgcgcaaactggcgccggtggcacgcgctaatggcgtacacatgaacatagaaacccatgatgagatcacctcatttgagattctacgtctgattgaagcggtcggggaagattgtctgggcgtggtgcttgataccgccaacatgttgcagcgtggggaacatccggtctgggcaacgcgccgccttgcgccctggattcgtcagacgcacattaaagatgcctatattggtcgggcggaaggcgggcttgatttccagccgcggccatgcggcacggggatagtggatttcaccgccattcttaccttactggcggaagtgaatcctcagctaaacctctcgctggaaatagcccgatcgtcagacgatcagcgtcgtgatgcaaacccacggcaatgcatccagattgacgatcctgtctggcgggcaggtcatccggacctgacgccagaagaacttgaggcgtacttcgcgatgctcaatgcgtatgaaaaacgggtcatggcaggtgaagtggctgactttgagttttacgaaacagcgaactacggctatcccagctatcagtatcagtcctacggttttgagcaggcgattggctttattcaacaatcctctgagcatatccgtgcggtatgtgcccgactgaatattgtgcttagctgaggtttgcgcagcgaaattattacagagatagtacaatccggttttcaacaagtgcgatagcggcttgatgcctgctattgcctgacaaggaacaagagatgaaaaaaacgcgcagtcgggcaggtgcggcagtttctggcacagcgttgacaggtggagaaggtcatgacgatgtttctgagcgcatccgtgccaccctggcggcggccattggcgaaggcgcactcaaaccgggaagcaaaattctggaagaagccatagccgagcattttggcgtcagccggactgtggttcgcggtgctttaggcgttttagaaagcgatcaccttctggagcgtaagcgcaaccggggcacctttgttgccgagccgggcattgaagaagcaaaaagcctgtttgaagcgcggcgtaaaatcgaagggctgctgctcgaaatggttttacggcgagccacgccagcccaactggatgcgctgacggcgttaaccgatgaagaagagcacatccatcagcatggcgatgagaaatccaaaaccgttttatccggtaagttccatcttgttttggcggagttggccggcaatcccgtactaaccgagatgttgtcgaaagttgtggcacggttatcgttggtgatggcgttatatgaagaaaagcacagtgacgattgtggtgctgaccatcaccgcatgattgttcaggcactgaaggataacgaccttaaacaggctcagcatttgatggaacatcatctgtcggacattgaaagccgcgtccgcttaacggcaggtcagggcgaccgtcactcatttatgtcggtgctggagaatttttcctgacaaacttgccgacgccgaggcaaccgcactcagcctgatgttggtttggggcttaatcgagaatgacgttatccgggctggaactgagcatggcctggcaacaggctgttagccgcaagccatttttcacggtaacgcgcggcagtgaaaagagatcggacagaaccaacaaaacgcatgtcgggtaaacgtggcgaggttactgtgaaaaaacgtggcaatcgccagactcaaaccgacaacgctacgtgaattctgaataactcgcagggggattattcgccagttttcgcgtagcgcgatcgattaggaatgcacttcaagacataaaagtgcgtaggtgaggagcccgtgataccggggagccatctgagtgcgtaattagatatcttatttaacataatatacattatgcgcactttaatatggtgggctttgacaggttcatcttacgtcttttatgtctgctacggcttttcaggatctgagcccgttttgcatctcaatgcttttgtctgatgacgttcgtctctcatgccgtcttcaggccaccatcataaagacctgtgctgctatgctgcatttcaatttaatcagacaacccaatttgaatgatgatcaacgaccacatctcttgtgctgcgacttatgttcatcacccggaacgcgcatcaattttgcttttagaaaacgtcttcatcgagaactcacagtgctttccataaagacggtcatccacgtctcacttcgcttttcgaaaacgtctcatggcagaactcacgctcagttccgtcatgccgcgtcgtgatatgttgtcaggctcagttgctgaagcctgctcagctgcaaactgacgcctgtaaaaaactgacgctgctacgtgaaagttagcgtactcaggtgccgcattccccacagaatccacccaaatcgatcacgaaattttggctgtctggtgtcgacatacagatcattatcaggaaaaaatcagcccgtcggtaatcacaatttcgtcattcatcttcagtcgtgcctgaggttgagatgtgatgcgttggcagcttacaccgccagggcatgcaatgaagaacagcgctgcccttttcttctttatcctgattaagccgttttgaccagagccggttaacgacttcatctcagttttgtttaagcctgccgcaggctctgctcgaacatcgccagattttcgcacgcttccttgtactgatggcaggcgtaaagagaaccagcattaaacagattatttattaatgcaaaaagtcgcgcatcaaatagcacttaatttaacataattaagacgcgatactttaacgccccgttatagtttttatgtagcgataacagagcgcaattattttagaataaggatatgcctaatgaacgtcggcgacggtttcccccgcagcctgacaatacggtaattcaggcagacctaattaactaatttaaagcagataggaaggcgatttgttggtgaactgcgttatacagtcatctaatatttgctgcgtgacttcagtcactttggcataattatgcgcccgccattgcggcaacgtatattgcggcgtgctggccgtactgccgcacacaatactggtataaagtgacttgccatctttatcttgcgttgcgcgggataaggctgtcgtcatgataagctcatagttatcatcgccaccggcaaagtttttataaatcagcttccatgtatacgggctaattttcactgcgtccgggtattttttggcaggatgtttatccatttctgtcttaagaatctcactgactctcggcatcagataagcgactgatggattagccagtcctttcacttcagtgcctttgagagacgaactgtaatgttttaagtgcgacgacttttgaagtatcaccttgcgtcacgtatcgcaactgattatcggttggtcgattaaagtcggtttccagctcattccaggcctctatcgttatttgagaactgttggcggaggtaatcgtttctgattgaaccagtttactggtcggcgggagtggttttgacgcacatccacttaataacagcgccattgccaacagtgaataattcctttttatcatcattctcaatcaatctattattgtatgtggaatgactatcggcgagcagacaggaagctttaattaaatataaaatataatttatgtattcaacgaagttaattcgatgctgccatcaccacgccctgctcttcctgatacaaaccgcgcggcgatgacggttattttgaatatattttatacaaccgttctcattttattcaggtctgtttcagggtagcagacgcagtatattggcaggataaatcgtgtcggctgtttcactgagtgccttgatggtccaccaacgtgcgctggcaataactgacttctcattttcactccagccctgcgtgttaatctcgtcacccgagacagtgacaacataaaaacgctcgtgtgccagaacacattcacctgagggcagcgtcatctcaaatctgcgctcacccacggacggaccaacattctcctgacgtataccggtttcttcataaagctctctgaccgctgtctgctcgaaggattcgccctcctctacgccaccgccgggcgtcgcccagtaggcattgcctgccagcgcatcctgttcctgtttatgcacgaaacgaaacagcaaaacggcatgggaagcattgaggatcagtaatcgggccgaacgacgagtgcgcatgtcatcttcctttttgattgggccagaagcgcatttaagcgttctggcctgcccttgtccatcaactggcgcgcaaaaaatcctgccagcgacgcgtcagatagttgtgttcatccatcacggcgttccacacggcaatatggctcatgcgctgttcgtagcttcctccgtcacgcacctcaccttgcggaatcaacggtgcgccccaggcatccagcagcacctcgcttgctggctgaccgccataccagaagtcccattctgccgcagacagatgcgcccggctgcgctgcgcgttggaaatatagtaaccctgtcgcgccatgacagcgcccggccagccggattgccaccagtttaaatagtcataggccgcgtctttgattttgccggtcgcgcagcgcgaaagcgacatgccgccataccaggcgcgataaccttctcgcgggcgtgccattttatagccgcgctgatgaaaatgatgacggaaatagatgggcgcccagaggctctgcacttccacctgctgattggcgataaggtcgcatgcctcgtcctgcgaggcccagaatgccgcgaaatgcccattgcgattaaggcgcgccagttgctgagtcagcagatcaatctcttcaagcgtaagattacctgggttggcaaaacgcgccaggccagcgccctgcatggcaagcgcggcatcaatgccgcccattgccgcatcttcctgtaaagccacctgccccgtcagcgaaggatgcaggagccagccccagctctcctcctgctgctgcaacgccgcgggcagtcggtcggcgtgataagcaaagctgtctgcattgtgcgtgagcggcagcatactgatgtgatcgctggcatggctgcccagatgcatatcgcgctgcacatacagccgttcagaaggcacgctgccgtcggccagcggcagatccggacgtaacctgccggttttcgccagcggggtaatttcatcccagtatttgagacgtttgatttccagcggctggatggcccgggcaggccagacaaaatcgatgttgtgaaaccactgatcgtacaggtcataactctccggctgcatgacggcaatgcgttgcgcatcttccacgctgtgcagcaggtattcgatacgaatgcccagatctttttcggccctgacgcgcagcatttccagcagcgtgacggaggtgccgagtacgcgtaatgtcagttgatcgttgactttggctgcagagttcatcgttttacttatcctttaacgcctgctggaagcggttaaacccttgtttcagccgttctgcgtcgagtccgcgcagaataaaaaccagcttcgatgtttctaaatcccccggccagtcattcatgtgtaccggcggatgtaacgtatgctgaaccccgtggatcaccaccggcgcactgctgccgctgaagcgtaagatgcccttcattcttagtaccgattgtccatggctatgtaacagcattgacagccagatagcaaacgccggccagttcagttcgtcttccagcgtgatcacgcaggtttgtgtcagagggtgatgatgcgtcgcctgtccggtcagactgtacgcggcgctgcccacggcaccgagccagcgaaaccgctgcgcgtgcgtgccttttgtcaggcgcagcgcaaataacgcctcaggttcggctagcgcctgcgctgtgtcactcagttccgccatggggtttaaaccggcaagccagctctgcagcgccatcatctcgtggtgatcaatacgatcgcgtttgctgagcaacagtttatcggccgcactgacctgggctaaccattccggctgatgggccgactgcaggcgagcgtgctcggcatccaccaacgtgaccagcgttccctgactgaaatggtgcttgagttgcgcatcgtgcagtaacgtcgacagaatgggcgcgggatcggccagaccggtggtttcgagaatcacctggctaaacggcggcagttcgccgcggatacggcgttcatacagatccagcagggccgttttcagttcaccgcgaatctggcagcacacgcagccgctgggtaacagcaccgtatccggtgccacttcattcaacagatggtgatcgatgccaacttcaccaaactcgttaaccagcagcgccacatcgttgagattttgatgcgtcagccagcctttcagcaacgtggttttcccactgcccaggaaaccgctcaggatatgcagcggcagtttttcatgttgcatagccgctcctttttgggccatcagagcgccgccagccaggtttcatccagcggatcaagagtgcgttttgtcatcttctccgcttctttccacagcaggtccagcgagctgaccatgacctgctgcccggtcgggctggacagcacccaactggtgtgaaatcccgttaagctcaggcgccagggtttgagtgcccggttaagcaacgccagttgcttcagacgcagctggcgctggggcaagtcgttttccagcgcgtcgctccactgcgggccgttatccagtaatccacacattccacacataaccagctccctatggcataacatcgccggaattaggccccagcgtctgaccgacaaacagattgccgcccggctcgctggcgagtagcagcgcgaccggtgccacctcttctgcccgtccaaaacgccccagcggcagctcagcggccttggcggttttccacgcctgattgatgccgtcaatcagcggggtttcgatcggtcccggcgcaatcgcgttcaccagcacattgtctgaagagacctccagcgccagcgatttggtaaagccgattacgcccgccttcgcggcggcgtaatggctcagttcggcaccgcctttgatgcccaactgtgacgcaatgttgattacccttccccagcgctgcgccagcatcgaaggcagcgcccgctgagttgccagaaagacgctgcgcagatcgaccgccatcatctgctcccacatcgccagcgtgatgtcggtgcagcgggcctgcgtcagcattccggcattgttaaccagaatatcaatcccgccgaagcgttcgaggcaggcatccacgcccgccgtcgccccgtccacctcaccgacatcggctaccacgccaaagcacggtgcgttcagcgcgccacagcgcgcgaccatcgcctccagtttgtcgccgtcgcggtcagtcagtatcagctgcgcgccctccctggcaaacagcgtggcaatggcggccccgattccgctggccgcgccactgatcacacagcgtttgtttgctaactgcatactctctccttaatcaggccagcgaacggtcaggccgccatcgacaatcaggctttgcccggtgagataactgctttcttcgctggtcagaaacgcaatcgtctttgccacctcctcggcccgaccaacccgtcccagcggaatcgcgcgagccgccttcgccagccctaccgggccaagcgaattttgtttatccagcgactgcggcgtttcgatcaggccggggatgattgcgttacagcgcacgccgcgcggtgccagttcgacggccagtgaccggcaaatgcccggcacggcagctttggcggcggcgtagtgcgcatgttcctgccagccataaaccccgcccgcaatcgatgacacggcaaccaggctggccccggtctgaagatgcgcggcggcggcgcggaacagtcgcatcacgcctgtcagatcgacattcagcatctcatcccagcgcgcatcgctcatctcatcaatccctgcgcggcgcagaataccggcgttggcgaccacgtagtcaagccgaccaaagtgctgcacaccttgggtgataaacgcatcgactgaggcggttgaagcgacattgagcggcagccagagcacatcgccgcccgccgcttcaacctgcgcggacgccagcgccggatcgtgagggtcctgcgggtagtaacccgcaatcacccgcacgccgcgttgcgcatacagcgttgccagcgccagaccaatgccgctggccgcgccgctgatggcggcaaccggtgttcccttatcattctgcatgtgctgtccttaagcctgaggctgggtagaagcggtagcgacctggctatcccgttgcgtcaccgggcgggcaaacagaataataatgcccgagacgaaacacggcactgcgccgaaccacagcgcggcttcctgccagtgtccgccctggctcaacaccgaggtggtgccgacaccggccacgatagcgcccacgggacccatcgccatgatcagtgcaccagcggtggcgcggatggccgtcgggaagctttcactgataaaaaacagggccgcagcatagggaccgatcaggaagaacagccctacgctgtacagggccacgatgatggcaaagttgtccggacagaacagcatggcggcaaaggcaataccgcccagcatccagcctccggcgatcgtgttgcggcgaccaatgcgatcaccgagccagccgtgtgctaaataaccgcagtagcccaccaggttcgagagaatcaggatcagcagcgagttattaaatgacacggcatgggttttggtaatcaccgtggtgcccagaacgctgaagatctgaatcgcgaaccagttcagcaggatagcaatgcccagcacgagcgtagaacgcagcgccgttccccgaaacgccgaggcaaaacctgacttaggctgatcctcataaggcactaaataatccgcggccacctgacgcgcatctttatcattaccctgctcgcgcaacgttttgatttttttctgcacttcaaactgtggcgtttctttgagccggagcgccagcaatgcgatgactaacgagggacaggcggcaaagatgaagctgccctgccagccaatgatcggcaacagaatggcggtcagcgctgacgcgaccagcgcacccacgggccagccgccctgcaccaggctgtaaacgaagcccttgcgtttattgagcttgggatcgtccagtgcgctgtacagctctgacagataggtcgcgtttaccgtctgctctgcgtaacccagaccggccacggaacggatggcggttagcgcgcccttgccccataaaccgcctatcgcggtcagcagcgagcacagcgcggcgcctccgaccgtgatcacaatccccatgcgccgccccagcctgtcaaccagtgggccgatggccagagcgattaccgccccgccaaaggccacccaggtggcaatctccgactgctcaacttcactccagccaaaatgtccgccgatttccggcagcagcgtgccgaaaaggatgaagtcgtagacggcaaaaatccaggcgaagaaggcaatccatgtggcgaacttcacatccctgatggttaactgctgcggctgccagccatttacagatttttttttgtagatgctcatgtcgcgatcgctctgctagataaaggaaagagacttaacgcggtttgcgcgctaagaagtcgtctgcgatttcgtcaaaagtgacaaatcgcacaccctggtggctttggatgtacttgatcaaacgttccagcatcagcagaacctgcgggcggcctgaaacgtcgggatggatagtcatggtaaacacggcgtagtcattttcgcggtagacccagtcaaactggtcgcgccagatctcttccagatgacgaggattaacgaagccgtggctgtttggcgactttttgataaacatcattggcggcagatcgtcgagataccagttggcgggaatttccaccagatcggtctcttcaccgcgcgccagcggtttcatccagctgtcgggatgctggctgtaatcaattttggtccagctgtcgccaacgcgaacgtagtaaggatgaaagtcgttatgcatcaggctgtggtcgtacttaatgccttttttcagcagcagttcattggttacattgctgaactcccaccagggcgcaacgtagcctgtcgggcgtttgccagccagctgggtgaccagctcaatactgcggtccagcacggcttcttcctgcgcaggcgtcatggcgatggggttttcatggctgtaaccgtgcacgccaatttcatgacccgcatctaccaccgctttcatctgctcgggaaaggtttcaatcgagtgaccgggaataaaccaggtggtacgtaactggtgctcggcaaacattttcagcaaacgcggtgcgcctacttcgccggcaaacaggccgcgtgagatatcgtccggggagtcttcaccgccgtacgagcccagccagcccgccaccgcatcgacatccacaccaaatgcacacaaaatttctttagccatgattcattcctctggaggagttaagcgcagacagacgtgtctgctgtgaacgtgcctgctaccgtgctggcagcatgaagaagccggcgatcttcgccagcaggaagggaaaaaagcaggctggtaggcagcccgtccgaatcggttccggtcggaaaagcgatacccggcatgtccaacaggctgcccggcatggttaaccgcaacgtggccagattagtgtcggcaaacaaggtgctgtcacgcatcaacggcgcaagttccggtgcggtatgggcgacggtgggcgtaatcagcaccgcgccatccagctctgcggcgagcgcctgttgccactgtttacgctgggtaagaaaggtcgtgagaaccgccgggtcctgatggctggcggcaagcagtcggtcgcgtacgcgcgggtccattacctccgcgtcaggcgaggctaacagctcgcgatgcagcagccaggcctcacgtccgcccggccagccgttgtcttcaatccacgccagcgcctggttaaaggccgccagaggcgcgcgctcgacgtcaaatccggcagccgtcagctgctctaaccggcgataaccgttgtcgcgtaccgcgggttggcatgcggccagtaaggcgtcatcgaaacgaaaatgcggtgcgggaaaacgcatcttttcccgtccgcacaggatgtcatccagggcgatggcatcacgcacgcttcggcaaagcggtccgaccgtgtccagtgactgcgccagaggatatacgccgtccatcgcgtaacggtggcggctggcgcgatagccaatggtgccgctgaatgcggcgggaatgcgtattgagccgccggtgtcggtgccaaaggcaatgcaggccagcccttcggcgattgcccgtccggcaccgctggaggagccgcccggcgcataaaggtgcggcgtgtttgtacggatggccggcgtgccaaaatagagatttaatcccaggccggagaaggcaaactcactgagattggttttacccagcgtcaccaggcctgcagccgagcactgggccaccagcgccgcgtcctgctgtgcgacagggacattttttcgcgtggccgatccggcggtggtctggctcgactgaatatcgaacagatctttccaggccaccggaatgccatccagcggactcagtgggcggcactgctgccagcgcagagttgaggcttcagcctcgtcgcgggcacgcgcggcggtaatggcgataaagacagagttggcgttttctgccgccttcaggcaggcctcggtaaacgccagcggtgacagacgctgttgtgcatagagtgcactgatgcccagtgcatcaatctgaccagccataaataactgacgaacgttttcggcctgcacgcgatcacctttaaatgtatattacgtttcaatgtacatttgaagatagcaataacggtgccaaaaaaagcactgttaagttgcataattgtgatcttgtcgatcattaaaaataaataatgatgtcaatcaaatagttaattatcgttatttaattttcattacgacatagcagaataaatggcgcgcccacattaaatgtattaatttataactgatccattattgggcgcggtgcactatatcagtgctgcatcagtgctgcatcagtgctgcgcagcgcaggcatcgggagtcgtgtcaggtatgctaatgtggctggcaggacggggaactgaagatgacacaatgcaaaacaaggtaaatgggactgacatggacgatgcaggttctgcgcgttacgagagtatccggcaggttttactgagagtttttcagcaggatggcgtgcctgaggggctggtattactggaaggtcccctggcgcagctgtttggcaccagtcgtgttcccgtccggcgcgcgttaagcatgctgcacgaagaaggctggattgcccgctttgaagggcgaggctttattgttgcacgtgataatcaggaagtggagcctgtccgcattgcgctgacgcgggagctgttcggccttgaacagcgcgatgaactggttgatacccgcagcacgggcgaaaaagtgctggagaacctgcaaggtattctttctaccgccatggtctttggctgctatcaggttgatgaactgggcgccgcgaaacactacaacaccagccgcgcggtaatacgtgaaagcctgatgcgcctgcgtgacaaaggactggtggaaaaagagccctattctcaatggctgacagggccgctaactgcgcgtgagctggccgaccattttgagatcagagcgaacctggaacctgcggcattatacaaagcgggcgaccggctcagtgtgacctggcttaatgaacgactcgataacgtccaaaagtaccgaggcaaacagctgaaccccgcagaactcgaaacgctggaagaagatctgcatatacgctgccttgaacccgccggaaataagctgatgatgcaaattttgcggcaaaatcagtcgccgtttattgtcacccgcattttttatgatctgctcaaaattcccgtcgacagcgcaatgcttgatgaacacggtctggtttatgagtttttgctgaaacgaaactgggcgctggcggcggcctgtatgcgagatcatctggagcgggcgcaggtcaggacgttgcagcgtctgaaagtgttgtcggtattaccggtgcctgaattgccggtatttatggagcgccagtaaaaatgaaactgagagtcagataaacatcaggccgacctggctccggctgccgcgttaaataatctgcgcaattatcgggtgtaatcgtaaattatcagcccaaaatcgcgttgcctgtaaaaatgcggctgtagcgccgcattatcgatatagcgatgaatcctgcggcaagcccttcacgtgaatacaccgcgcgttacctgcccgtctttcacctgacgctgcttgtgttaagaagacttaatgtaattgttagcttataataactccgcttttcaataacactaacaaagctgcagcctgctgagacggatctcacgccattttccttatatgtcgggaacccttttcagtatcgccagataataaacagcttgtccctcccaccgacagttagcgagcttattattgtgaataaattaacggcattgaaaaaaggatatgcaaaggtctttttatggcttttgctcacgctgtttttaacccctgctattacgttgacgtttgccaaatacggcagcaacgaactcgacaaagaatatacgcaaatctttatcgatgatgcgcgtgcgcaaaatcagaatgtggggaaattaacgcgcttcctgcaagctaatcccccatccactgtttgtggccctgtcgccgacgatctgctcgactataaaaatgccgtctgcggcccgggttctgagctgtcgcaattttatctcatcggcaaagtcgccctgtggacaatggttttcagcggcgtcattttgctgatgattttactgtttagcgccctggcctttaaaagcagacaaggacagttactcagtctcaggctcgcacgtccctttctgatgctggcgtgctcgttgcaggtgctggtacagggcgggatgctggtatggctgtcgttctggggcaccgcctttttcacgcaaaaatactatccaaagctggtgctgctggtcgcactgctggttttagcgggtatgtattacatgatcaaaggcatctttaaaaagctgccgccggaggacagcattgaaggcgacgtggtgacccgtgaagccgcccctgcgctctgggcgcgcgttgatgcgctggccgcgaaggtcggcaccacgtcaccggatcacatcattgccggaatcgataccaacttctacgtgacagaagccccgctgagcgtgaatgatcagccgctgcagggccgaaaactgtatgtgagtattcccctgctgcgtcagctcagtaccgcacaagcggatggcgtcatggtgcatgaactgacgcacctgcatgaaggcgataccgcgtcgggtgcactactggggccgaagctgcaccggtttgatatgtacacgcatttgatgagtgagaatctggcaacacttatcgttttctatccgctctatctgtaccggctgttttttgaactggcctggcagcgcaacagtcgtgaacgcgaatttgtcgcggaccgaaatgcggcaacgctggtttcctcgtcggcgattatcgaatcgctgatcaaaatctcagcctatgccagctatcgctatgaggtggagcgtaagctttttgagaataaaacgctgtatgagaatgaacccggcatcagtcaggcgatcgcagccggtctgcctcaccatgttagttcttccgattttgtcagcgcgatgcgcgaacaaaacataccgcatccgtttgattcgcatcccccgctgtctgaaaggatgcgcaacgttaactattctgtggaagatgcagattatgccgctatcgccgcgacctcaccggcagacagttgggtcgatctgatccccgtagccgatcagattgaacaacagctctggcagaaatatgagcgtgactttacgtcgcaacatgaagagagcctggcctggcgttatcagccaaccggtgaagaagaaacggcgctggtcttaaagtacttcccggatgtgccctttacgcttaaagatggctcgcagttgaccattacctggcagggcattgtgcagccacagtccaccgggctgctggaatgggataatgtcaaaaacatcaacgttctccgtcagttcggcagagatattttgtatgtgcagcatgtccagcccaatgcgcagggcaaaaagcgcagcaaaatccgcttaccgggtctgaaaaaagagattgagaacgttaagcacacactcaactattactggcatcgtcaccagaccgtgcaggcgctgaaggcacaggaactcgccgaaaacagccagggcacggcgtaacctctcccgtcgctggcgtgccggcgacgggtttatttcccgcctgcaaacagcggttgccggtcaggttcagcacgaacccgttatcggcctgtcgccgctgttgcttcgacctccagtaacacaccgtagtgaagttcaggaaccggcacgatggctctggcgggtttccacgcgccaagccattgtgcatacaacgtattaaattccgcccaacgttcgacatcgaccagatagactctcaccatcaccagatggtgcttgtccaggctttcctgctgcaggcaggcctccagattagccattacctgcaaagcctgctcggcaaacgacgcggtgctgagcatttcgcccgctgacgtaaccggcaacaggccggagataaacatcatccccgacgccagagcataatgtgaatagtggcccggatgcggtttgtcgtggatatcgcgcgcgtgtatcactggttgcatctttcctccttacatcatgcccggctttttcatgctgctcccgtcacggaaacgggaatagcggaacgcggcaggatcgacaatcggtgcgtctccggtcaccaggtccgccgtcaaacgtcccgcaccgggaccaatgccaaatccatgaccgctgtagccggacgagaggataagtcccggaagctgcggcacggttgagatgaccggaatgtcgtccggcatacagtcaatcacgccgccccaggcctggctgacacgaagcgacgccagcgccggaaactcgttgccgatggccgccagccccttttcgacgacgccgtcagagacctgcgggtccagtacacgggttttctcgaagggtgaaacgccctccatggaccagctcgcccgcgactctgggcccgttaagaaggacgccagtcggattttggtttgaagatttaagcggcgagctttgtatagcgggaaaaactcgcgggcatagcgtaatccctgaaagcccggttccagtcgtccggttcccgacagcgcaatggtatatccgccgtccagtcgtggacgacaggcaaaagcatccgtgtaaaaaggcatggtgatgagttgctctacgggacaggtacgaaatgcactgccaatcacgttaccggccggtagatcgatgccgtgacggcgacaaaacagcgatgtccaggcaccggcggcgcacactacgctggcggtttttatcagcccgcgttctgtgatcaccccactgacgcgccctgccgaaatatccaggccgcgcaccgcacagcgctgaaacaggagtgcgccctttttcacggcggcttccatcaaccccggcgcggctaacgccggatcggcgtgaccatcatcaggtgaatgtaccccgccattccaggcagtggtactgcccggcgtcatggctttggcctcggcggcactgagcatccgactgcgaataccgtactgcttcgccatttttccccagttatcccagttgcggatatctttttccgtccgtgtggcatagaccagcccgctggcacgaaaccccacgtccatgccaatttcgtcactcagcgcatgccagcgttgcagggcatgcataatgagcggaatttcccgttcgtcgcggttaagctgacggcaccagccccagttacggcttgactgctctgccccgaccaggcccttttcgatcacggcaacccgatagcctttttgcgtcagttcccagcaggtggctgcccctgcaattcctgcaccgataatcaccacatccaccgaatcggggaaatggatactgtcctgaacaagtctgagcggtgcgggcatagtcggtgctctccagcgaaggtgttagctgattaaaaatcgattaatacacttttgtagcgctggcaggactcaaaggcctgcctgccaagatccttgccaaaaccggacccctggaagcccccggttgggatgataaagtcccaggtccgacgataacgattaatccagaccgtgccgctatccagcgctttcatcaaccgcatcgcacgcggcatgttcagagtatgcacgccagcacacaggccaaagacattgtgctgcgccagtgcaagggcttcttcttcatcgctaaacgtctgaatggtcagcaccggtccgaagatctcctgctgattcgcgacgttatcctgactgacaccggataacagcgtcggttgccagaaccagccctgcgcggtattttcgtaacgttgaccgcccgccagaatgctcgccccctgtgccacggactgcgcgataatcgccgccactttttcaccctgtcgctggtcgataagcggacagtaacgggtcgatgcctgccaggtcataccgggcacgggtttcttgcacaaggcaatcagtttttcgatcaccgcttctgctatgcctttctggatgatcaggcgcgtgcctgagacgcaggcctggccagcattcacggtgaagcccagaaacagacgctcggctatctcgttggcatcgcctgcatcatcaaacaccagttggggactttttccacccagctccagcgtcaccggtttggtgccgtgcagcgcggcctggctcatgattgcggcgccggtcgcagtggaccccgtaaaagacacttttcttacctgcggatgcgtgaccagtgcattacccgtaacctgcccgccgccctgaatcacgttgagcacgcctgccggaatgcccgcctgcaccgccagctcagccagacgtgcggtagaaaacggcgtcagctcagagggtttcagcactaccgcattgcctgccgccagggccggaccgcacttccatgaggccatcgacagcgggaaattccacggcgtaatcgcaccgatcaccccatagggttccggcaccagcattcccaggctgctgctctgggtgggaaaaacatcgccactgtatttatctgcgcattctgcataaaagcgcagggccgccgcagtaaacggcacttcaatattgcgggtgtccgtgatcggacgcgtggaaccgaccgcttcgagttgcgccaggtaatctctgtcgccgtcgattaaatctgcccagcgggaaatcgccgctccccgttcccgtggtgaacagcttgaccagccgctgctgatgcgcttttcatccgcaatagtcaccgcatcagccactgtagcggcgtccgcctcgttgatgtcggcataatgctgaccatcagagggacgtttgatacccagcgtgcggccggatgcagaaacgaactggccgttgataaagtggccggtagaaagacggaccttatctggatcaaaatctgacatgatgtcctcgcacaatgaatgaaaaaacacccggctaccagcccacaacccgttgccagacttgatgctcgccgttccgggtgtcgatcacctggtaatgcgtatgcatcgcggcggtcgcacaggcatgattgggcagcacgcgcagcacggtgccgagcgggaagtctgccgtcgaataatcaccgtaatgtggcagcgcaataatcccgtgttcctgattcgtggtcgtcaggagcagccccaacgggcaaccttcgtcgtcgcacaccagcccataaccgtaatcggtgtgctgagcggcggtgccgcgatcgcgtgacatggccatccagcctgcatcgacgaagatccagcctttatcgtgattgtgcccgatcaccgtggtgacgacggaaagcgcgatatcgtcgcgggtgcaaacgcccaggttatgcataaagagatcaaaggtggaaaataccccggctctgacttcagtcacgccctgcaggtcatgggccgcatgcgccgtcggtgtggagcctacgctgaccaccgggcacggaatcccggcggcacgaatatgatttgctgccgtgacagcagcctgacactcttcctgtgcggcaaggataatctcctcctgcgaccggcagtggtaagactcaccggcgtgcgtcatcacaccttccaccaccatcccggcctggtgcaaatgacgggcaatcgccgtcagcgccgcgtcagcaggttgaattcccccgcgatggccgtcgcagtcaatctcgataaacacggaaaagatcacctgatgttgtaagccgtagtcgctgacggcctgtgcctgcgccatgctgtccagcaacacatgcacctgtttcccgttgcggcgcagggcggcaacgcggggtaacttaccgggcgcaatgcccaccgcataaagcacattgctatagccggcggcggtaaaggcctcggcttcggccagggtagaaacggtggcaggcgaagacagatcctgcagcaaacagggggccgcctggagggtacgaagtgttttgagatgcgggcgaatctgacagtgctgtccttcaatccgctggtataaccgattgatattgcgttcgaacttaactttatctaacaggagataaggtgtcgtcagggttaaatgattgagcatcgtcggcattcctgtagaggtttagttgatgctctcatcgtttaaatctgtttaaaatgcggtcatgcccaattaatgattaggtttgaacctaatgatcaacagtgaagatttacgtttttttcaggtcatcgcctcacatcaaacccttgccgctgccgcacgctatctggacatcaccccgccctcggtgacgcagcgtctgcaaagcattgaaaataaaattggggttaagctgattctgcgcccggcaaaacgcatcatcctgaccgatgaaggcgaagccttgcttgagcgggcgcgcgtgattttgcatgagatagaccagttgcaggacgtgattgaccagacgcgaaaccgtatcagcggtacgctgagagtgctggccccgctgggctttggctctgaatatattgcgcccttactggccgattacgcggacagccacgaggatctcagtatcgatctgacgctctccgataaccccgactggatgcaggccgataagtgggatgtggtgatctatattggtcatctgcgtgactcaacgctttacagcacgtggctcgccgccaatccgcgtattctctgcgcctcgcccgcttacctgcagcactatggcacaccgacacatcctgatgcgcttcatcgccaccactgtctggtgatcagggagaatgccgaggatgtcacgcgctggatatttacccataacggtgacgaaaccatcgtcagaattacgccgcgcctggccagcaacgatggccgcatcatcaaaaaatgggcgctgggcgggaaagggatcatggtgcgttcggcctgggatatccgcagtgagattcgtcaggggttgcttatccccctgctgcccgcgttcaccctgccggcggcggatatcgtcgccctgaccagcctgcaggagaaaaaacggcttccccgcacccagggctttatcgaattaatgaaaaaaaccttcagctcgccgcagtgggaagccgggtaggttttctctcatccccctgccgccagcggtggctcaggataaaaattctgcctctgtgactttctcaagccaggtcaccggactgccgttaagggattcggcaatcgcaatatgtgtcatagcggtgttggcagtcgccccgtgccagtgacggacgtcttgcggtatccacaccatatcgccctgattgattgtgtgcttctcttcaccttcacactgaatccagccctgaccggcggtgactatcaacgtctggcccaggggatgcgtgtgccatgccgtccgggcacctggctcaaaggtgacggtagcgcccccgacccgggccggtgaggttgtgctgaacggagcgtcaatgcggacctgaccggtgaaatacgcctcaggtcctttggctgagggaacggatgcatttttgatgattttcatgatggccttacctctgatgaatggaatcgatacagtttatgcgtgaaaaacaggaatacccttctcgctttttcacagacgagacctcaggtgctgaaagagaaggttaacgcgctgattggttttagcgcgccgctgcaatactgcgtcttcccccttggcgctgagccatgcaatacgggaacgtgaagaaccgatgggagcaggtcttctgtcgcccaccacccgacctgtcgcgcccatgcgggcaggagaacgccggttgaaaaggccaggctttgcgactgagtgtgataacaacgcgccacgttgaaaaaaattattttttttctgcatccagtttgtatcccgctctcgtatatctcattgaaagccacttactccacgctctaatgaggatttacgatgaaaaagctaattgctgttaccgttgtatcaagtgcattgctgtttaccaccgcatccatggccgctatgacctcggattctgttatggtgggcggcgcggctatgttccctcagaaaaatattgttgagaacgcggtcaattccaaagatcacaccaccttagtggcggcggttaaagcggccggtttggttgataccttagaaggtaaaggcccttttaccgtgtttgcccccactaacgcggcgtttgctaagctgccagctggcaccgtggacaatctgttgaagccagaaaataaggccatgctgaccagcgtactgacctatcacgtggttgcaggtaagtatgatatgaaggcgctggaagccaaaattaaacaaggcggcggtcatgctgagttgaaaaccgttaacggtcagccgttgtggatcatgaataatgggccccataacatccagctgaaagacggtcagggcaacgtagccaatatcagcacctatgacgtcaaccaaaaaaatggcgtgatagatgtgattgataccgtattaatgccgaagtaattatttatactcgaacggaaacagatcatccgggacgcttatggacaaggtgcaggcagtggagcaggtaaaactaatgaaggcagtcgtcgacggcgatcgccgggcatttgaacacctttaccggctgacatcgccacacctttttgccatcgcgttgcgcatgttgcagcaccgcccctgggcagaggaggtgctgcatgattgctatatcaccatctggagcaaggcggaaacctataatgctgagctgagctccccgttgacctggatgacccatattgtccgtaatcgctgtattgactggctacgcagcggacaggcgcgtatggccagttcggaagaggcgcataatgatgcgcttctggttgctgaacatgacgaactgcataacagacaggatgatgcacaagccgctcgcttacagcgctgtctgggaaacctcagcagtgagcagcgtcagagcattacgcttgcctactatcagggcatgtctcacagcgatattgctcactggctccagcagccggtcggatcggtaaaaagctggatccgccgggcgatggcgcaccttcgggagtgtgtcggactatgaataaacaacaccaacgtgacgatgcactctctgctgaatatgcgcttggtacgctacgcggtggcgcgcgattacgttttcagaagcgcctgcagaccgagcctggactcgctgaacaggtcgccaactggcaaaacctgctgtccgggctggatcttcacgtcatgccgcaggtgccaccggcgtatgtctggaagaaaattgcgttaagtctgccggccaggaaaaggccccgcgctgctcgcgcctatattggctggatggttgccgccgcccttgccgccctgacgctggtgtcttatcaggccatcaaggccccagaatttacgccgcttaccgtgatgaatgacgcccagcaccaggggcaatgggtcgtcagtgcagacaagacgctcacacaattgcgcgtcacgccgttgcagcccgcgacggtagccgccaacaacagcctgcaactgtggctgattcctgccggtcatcagccggtttctctgggactgctccacgcgcgggacaccaccgagcttaaactcgcaggacgtgatgcggtaaaaaacggggttattgcgattagccttgaaccggagggcggttcaccaacaggtcagcccaccggtccggtgctctacagtggcaaaatataatatcgaaatgcgatacgacacgtgatgcagaccctgggcatattcgagtgaaaaaaatcccctttcgagccttatagcgccccctgggtggtcactatcagtgcgaccgccctgggcgacatccactctaaaagcgttgccagttatcttcctgcttagcataggccgcacgagcctgaacaaaggccggagaaatggcggcagggctggcctggacaaccggcgcgtgctccgccagcacaaatgctgcgacaagttcgttcagggccgtggcctgatccatcagtgagcgagaggccgacgaggcttcctccaccagcgccgcattctgctgtgtcacatcatccatctgattgaccgcctgatgcacctgaccaataccgagtgactgctcctgagacgcgacggcaatttcatccacaagatcggtcacctgacggatcgcctcattcatgcgccccatattctcacccacctgctccgcctgattcactccggtttgcacataacgcatggaggattcgataagctctttaatttcgcgcgccgaagccgaagatcgctgcgccagattgcgaacttctccggctacgaccgcgaatccccgtccctgctcacctgcccgcgccgcttctacggcggcattgagcgccagaatattggtctggaaagccacgccttctatcagggtgattatggcggtgatcttttcagagctgtgtttaatgtcagtcatggtgccgagcatcgtatggactttcgtggagctgtcatcggaaatttcacgggcgtttttcgacagttgactggcaagtcgggtgttttctgccgtctgacggacggtttcactcagctctgacatgctggcggccgtttgttccagcgaagccgcctgctgctcggtgcgggaagagagatcttcattgcccgcggaaatttgcgaggaggctgaactgaccgaatgggccgaccgttcaaccgatgaaagcgagttcgcgacattcccgataagatgattaaaggctttagccgtcagaccaatttcatccttgcgcgaatcatcggcacgcagcgtaagatcaagccgctcactggcgcgttccatggccgatcgcataccgttaaggtttttacggatgcccagaatcgtcctgatggaaaaagccccgagcaacaggataatcgcgactgaaccggcaattaacgaccagagtgtttgccggtaaacccggttattctctttttcaaataccgcgccgacctctacattgagctggagttgtttctgataactttcaattaaatcacgaatagtctgaccgacgccgctatttccctgcaaatccaccagggcggtatcattatgtgtccgcgaatttgtcagaaaagccggcaggcgcgcttccatttgtttaatcagcgctaaggcattttcactgagcttcgtatcctgatcgttagtggtttcgttcttgagataaaattcagtcagtgctttaagcgcttcaatacgcgtgaatatttccttttcaaattcggcctgtttatcaatgactttcgcgctttgatgccgatagagcgctacgttaagtcggttactgccgttaaccattttatccaggtcaacaatcgagggcagtgtgttggtttgcacgtactggaagcgcgactgaaagccgcctaataccatgatgacgatcacaaccatagcaatcattgatgctgagagtaatgaaaacgtcaggaaaagccgctgagtaatagtcatgtaaatttcccaaaataataggttcgccagtctgtacaccgtactgaatgacattcgctattcaggtatcgacagcgcgggaataagcattaatgcgccaaatgatcattgcggggaataacggagatagtgggtataatcgggataaaaagtattagtgcgttgaatgtataaagaaattgacaaccttatcttatctaaaaacaataaaaataattaatggatagatcaaagtggaatttatcattgttgatggcggaatacgctttttaaaaaaagcatgtgacgttaatgcatgaaagttcggttaagggtagttaaatctcgttcctgacgacgtgcagagggatgatatctttgccaacatctttgaaataaattaaccgcataaaatgacgagcgaattaatcattagtaaggactatttttaaaatattttcattttttgtgtcacgtcttccaaaaaaccggttacctgcttctgtgatattgcttacatgcagacagtgggtgtcagtcaggatgacgctgttctgcgtcagcccggtagtgccctttggcaacttatctggcttgcttcatctcgcgcattgcgcggccctgatgtggtgaagccgtcgggaatttgccttagtgcatcattattttacaggccgttttaggctgtaacggaataacccggtcaagggcgcaaaagaagtgatgagttaatcgacaaccgtgtaaaaatgccgtaaaaaaaaggcacaaacctgtaaaaatgtagttcataacttcaccacctactccctaacgcacgctaaaccgcgtaatctcatcctcacctctgaccgggttaatggcccggcggacgttggtgattacgcgaagcaaaacaggatattaaatggcgcagtctgaaaagcagtccctgcctgcaggtatgttggcggcagcggggatcgtatttggtgatatcggtaccagcccgctctataccttaaaagagtgtctttctattcttccctctggggcggtgacagaagaagccgtgatgggttttctgtccctgatattctggggactgacgctgattgtgacggttaaatacgtcatttttatcatgcgcgcagaccatgatggcgaaggcggaatactgacgctaatgtcgctggcccgacaaaatgttggcgcacggctcagtcgcattatcgtccttgctggcctgacgggcggggcctttttttacggtgacggcattattactcccgctatttctgtgctttccgcggttgaggggattgaagtggtggccccggccctggatcgttatatcgtgccgctgtccgtggtgatcctgacgttgctgtttgtgattcaaaagcacggtactgaacgcgtcagccgcatctttgggccaatcatgctggtgtggtttattaccctggcagtccttggggtacgcggcattgttatgaatccccacgttttacatgcgcttaatccggcgtttgccctgacctttttactcaatcatgaagccctgtcctttgctgccttagggatggtggtgctggccgttaccggggctgaagccctgtatgcggatatgggacatttaggcaaaacccctatccgcctcgcctggctgatcattaccctgcccgcactggtgctgaactattttggtcagggtgcgctggtgctggccgaccccagcgcagtcaaaaatccgttttatatcctggccccggtctgggcacagattcccctgattgtgctgtcaacgctggccacggttatcgctgcccagtcgattatcagcggcgtgtatacgctgacgcatcaggctatccgccagggctttctgccgccgatgcgcgtgatatttacgtctgctacagaatcggggcagatttatattccggtcgtaaactggcttctgtttgcggctgttacggtggtaatcctggctttccgtcagtcttcggcgctctcttctgcttacggtattgtggtgacgggaaccatggtgctgacggcctgcctggccggtattgttgcctttaaaaactggaagtggccattacctgttgcgctgtttttcctgctctgcatgttgttaatcgatgtaccgctgtttgcggcaaacctgatgaagctgctgtcgggaggttgggtgccggtgctgctggcgatgacgatgctggtgctgatgcttatctggagcagtgaacgctcccggcttatccgccgtctcaccgacgatcctgtgaggctgaaagcgttaatcagctctctggaagcctctccgcccatgcgcgtggggggaacagccatcttcctgacgcgcaaagagtatgaaatcccgcaggccctgctgcataacctgaaacacaaccgggtgctgcacgagcgtaccgtgttactgcacatcaaaacggtcgatctgccccgcgtgcacaatcagaaacgcatcgcgctgcgccagctgtcgccttcgttctggcaggttaccgccgcgtacggctggcatgaacgcccgtcaatgaaagatgtgttgcacctttgcgggctggaaggatttggctgtaccttgaatgaagcgtcgttttttacctctcacgacacgctggtaatgaaaaaacgtcgcggcctggcccatgctaaaggggcgatattccacttcttccagcgtaatgcattacgcgcgcatgaacagttcaggataccggccaatcgggtgattgaactgggtgggcaaaaagagttctgataagggattgcggcagagtccctgaggggctttgccgctttccgcttgcgtgatgaatcttaactgccagcgcaccgcgttcaaccctctgctgccagcccacaatccttcgctgcgcctcgtcaggcttttttcaaactcgctggcttcactctgcgtcagccgcatgtgcgcaggctgtgcgacgtcagcccagggacaggcttgctcttctcgtggctaaaaaacctttcgttgctctggcgttcactttctgctgagttcgcctgttttagcgcagcgccataatgccgtgcagccatctctgtttcttgtcatcgggaagccgtgggttattgcccatcaggccggactgacacacggcgagcatcctgtttggggacggcacaagcggctcatgagtcatcagcgtgctgacgcctttcaccctgacgggcacgtcatgctaaagaaaatcgctgcacgcttcgggcgacatgctggtgtctttgacgttaacccttcacaatacccttaccagttcaccctgttttgttaatgccactaacatttcatccctgtcgcgcgacgcaaggttgcaggatgaaaaaaggagcaagccatgtctgatgctacatcgggtcagtgccactgcggcgctgttgcgttcaacgttgaactgctggatggcctgaaaaccgcccggcgctgtaactgttcgttttgtcgtatgcgcggtgcggtcgtggtattcgcccccgtctccgggcttgaggtggttaaaggtaaggataagcttagcgagtatcggtttaatacgggtgaggcggttcattacttttgctctgtctgcggcatttacacctttcaccagagccgttccaaccctgaacagtacggcgtgaatgccgcctgtctggcgggggtttctcctttcgattttgcctccgttcctgtgacagatggtaatcatcatcccaaagatggcggtaaaggcggtgtggccggttatctccactatgtggcagaaaagccctgacggtcagtccgtcaaagccagtcaggctggcgtaccctttccagcatgatcatcgcatggctgaacaccgcgtcagccatcgccagaggataatcgtcaggcaggttgtcgcgcagcttaacgatcgcagccggtaaacccgcaataaaggccgtcagtatctgctgcatcttcgcctggcttaatccgacgctgcccgcgctggcgacaaaatgcgctggccagatcgcgtcaatgtgatgccgtttcccctcagggccgggcacgcccatcgccagctgaaaatcttgcctgtctgtcctgcgcagtgaaagcccgggacaggcagacaggatcgggctaaagggggccagtcggaaactgccgccacgggcgatgagtatcctgatctgtttagcgtgcccgccggtagctccagtcagccactgaaaaaccagatagcgcatcagctcctcacggtctttcatggcgcagctcgaccccatcagcaaggccatcacatcctgaagccccggtccaccctgctgttcataacggcttgacgccggtaatcccagcgcctggcacacatcctcttcaggaagataataaagatgttttccgtcacggctccagcggcgatcgtagctttcgatgcgtaatttccggcggccatcctcatgaaacagcctggcatccgctaccgggagccttagctcgcgggcaagggccatacacagaaaggcattgtcgatatcagactgctgtgcctcgtctgcagcgctgaccacgcggtaggtcgcgttatccggcgcaaggggttgctgcttcaccggcagcagcgtgatcgcgccgggcagttggtgtcccactttttgcaacagtgcaaagacatcgcaggattttatcgggtgctcagcgtaaatatcgcttttaatcaacgtgctgggtgagagaaggttttcgaaaaagtaagccaccttcgcagaatgtatcgcagcatgctgcaagggcaatgaaagcgacagcggcctggcaagcgggtgcctgagccactcctcgtcatactggaaacggagtgcgccgctgtgatgcagcgtcagcgtgcccgtccgcgccccgttcatccaggcaatcagcttcgccattaccaggcatcctcagatgaggctgacgcgggtggattcccctgaagcacgacggcaagattcagcgcctgcaagattttgaacagggtagccagcgacgtcgtctccgggttgttttcgaagtgggacaaggttgcctgtttaaggcccacggtcttcgccagttcagcctgcgtcaagccatcttgttgacgcaatagctttacctggttcgccaactgcctggggctgtagatcatgtggcacgctccgtaataagtgagttttatccccgccagaggatattatcagactaactgcaacataacctgaaaagcaaaaatatcccctacagcggatatttgagagaaagcatcgccccgttttctccgcacgcgtttctctctgagggtaacgtattacagtacagagcaggacaggcaggatttgctcgccgggcggcgcgctgaccataatccgtttatcgataccgcgacatatcgccagctggcgggatgttgccgcgataaacaggggaaattacgggtcgggctgactggcagccaaaaaggaaacaggcggtgtattgcgttacgctgggcagcgaatccctgggcggttcaggctggatcaacgctgggttaaggcagcagaacagctatcgcggcggatggccgtggtgcccttgccagatagcttcagttttcaggcgttgcccttctgcttaatgtattgcagatgtcactgacggatttccccgatgtcggcatactgcttcattatctgatgcgcgcgttaaacaaggtgagctgactattagccatgaaagacacaaggatgatgccctgcccattccatgatgggcagggttaaaggtcaggcaatgtttatcgtgcagtcgcttaacatgcgccagtggcaaggcagaacgcgtgtttcacccgtcaccgttactgtactgacgccgtggatatcgcgacaggaagaaccgacctgcagctcaaactcgccgggttctacgatgcgctggccatcgcggcgcgtaaagttgagcatatccaccggaagcctaaagcacagttcggcggttttacccggctgcagcgtgacgcgctggaaagctttaagctcctgaagtggtcgcaccatgctggccaccttgtcccggacataaagctgcaccacttcactgccctgccgttcgccggtgttggtgagcgtgacccggagttgaatctccccatcaatcgccacgttgtcctgttctggctgcggctggccccagtcaaaggtcgtccagccgcggccaaacccaaacggatagcgcgcgccaaaatggaaggcgatcggcgtaccgccgcttttcagtttgtgattgtaataaaacggcatcgcaccgacgtttttcggtacgctcaccaccaggcggccctggggttccgcgcggccggtcagaatatccgctatcgcccagccgccctcctgccccggtgcccaggccagcataaaggcggcaaccttgtcttccagaccttgcaggctataaggccgtcccccggtcatcacgacgatcaaaggttttccggttgcggcaagggcctccagcaatgcttgttgtacgccgggcaaattcaggctgtcggtgtcagaaccttcacccacggtgccgctctggaacaggcccgccagatcgcccacgcaggcaatcaccacatcgctgtcttgcgccacgcgaacggcatcggcaatcaggtgggtatcctgtgacacaggcgattgctgcatgggtttcgccgcgctgtcgccggggaacacaggggcacctgcagtgcgtttctcaataatatgacagcctttggcatagccgacattttcctgccccagataatgttgcagcgcggcgagcggcgtggtgacctgcgacgtttcctccagcatatcgctgataatcaggtgaacgggaaagctgtaaccgctcagtagcgcaagcggatcgtccgcacagggtcccactaccgcaacgcgcccgccggttttcagcggcagaataccgttattttccagtaaggtgatcgactgggttgccacatcacgtgcaacctgacgggtggcatcgtcctgcagagaaatcgccgcttcattgatataaggatgctcaaataagcccaggcggaacttctcggtcaggatgcgtgccacgatctcgtcaaccttatccatcgacagcagattacgcgacacggcgtcggccagatggcgagcgcagtcatccttcggcaactccacgtccagcccggcattaaacgccagcgcagccgacgttgccgcatcctgcgccacgccatgatgctggtgaagcagactgacaccgccataatcagccacgatgatgccgtcaaatccccactgttcacgcaacacctcggtcagcaaaaagcgatcgctgtggccgggttgattatcaatgtcatggtaggccggcatcaccgatcccgcgttcgccagctttaccgccatttcaaacggcagcagaaagatatcgtttaattcgctgaagccgaggtgaacgggcgcgtgatttcgtgcgccctcgctgaatgagtgaccgacgtaatgcttaagcgtggccagcagatcgcgcttatcgccttgcaggccttcgacataggcggttgccatcacccccaccagccagggatcttcgccaaaggtttcttctgtccggccccagcggacatcgcgggaaacatccagcacgggggccagtccctgtttgcagccaattgagcgggcttcgtcgccaatgtgctgagccgcccgcctgatcagttcaggcgcccaggttgatccgtaattcagcgatgagggaaaaagcgttgcccctttgcacagcaggccaaccaggcactcttcgtgaaacagcgctggaatccccaggcgcgatccttccatcacatcacgttgcaggcgattcgccgcccgtacgccggttgcggcgtcaacaatatgtgttcccaacgggcgggtaatctggccgatgccgcgggttaatctctctttaagggcattctgggcactcacaccggtaaaggtgtcgcttaaatctgtccgttccagatggttgcccttttcatccaggataagccagtaagcatgcatctgcgcgaacttttcctctgccgtcatgcgtggcagcaggtcggcaacacgttcactaacagaacgctgagggtccttgtagattacggtcatgtttcactccttcgtactgatttcagatagcgttttgggcgtccattttctcttcagcggcacgctttgcggccagctcaagggcaatcgcattgacgcgcgtgctgttaagcttgtagaggcaaagcagcagcagcatggcaataaataaaacgccgggaataaggttgtgcatcagattgatagtggtaatcacgtgaggcgtttgagccgccacgccaggctggtagtgcaccagccccagaatccagcccacgacggcaccgcccatagcgaggccaaatttgatggcaaacaaggcggtggagaagaccaggccgtccagccttctcccgctgcggtgttcttcgaaatccacgacatcggagaacatattccactgaatgggcgtggtcagattttgaacaaagccaaaaacgatatttatgccgatgatcagccaaacctgtgaaggcggaataaaataaatggtcgtgacgaaaaaaacaaaactgaccaggcaaatctgataagcacgcacgcggtcaaatttccccaataaccgctctgaaaaaaatgcaccgcacaatgccgctatcatgccggtaataataaaggtgaataccaggtcaggccgcaataaaacatagttcatgtaatatattgtggacgagccacgcgttactaccgcagtcagcaacaggatgttgaaaataacaatgatgagccactggctgtttttacttaacagcttcaggtcggaccacatcgaacttgcactatcgccgcgcggtaaataacgttcccgggtcataaagaagcaacagtagattaaaatcacccctaaaaaacccatgaaccccatggcaaacaggtaccctttcgccttgtcgccctgacctaacagatccaccagcggcagcccgatgaccgtgaccaccagtccgccgataaaggcacaggcaaaacgccaggattgcagagaatggcgttcccgtggatcgagcgtcagcgcaccgggcatggcgcaataagggacatttactgcagagtatatgaagctgaggatggtataggtgacacaggcatagacgattttcgcggtcggacccacatcaggtacatagaaggttatcaggcaactcacgccaaacggaatcgcgaaccacattagccaggggcgaaaacgtccatgtcgggttcgggtgcggtcaactaacgccccgatacagggatcgacaaaggcatccgccagacgaaccatcaaaaacatcgtccccataatcgcggcgggtaaaccaaatacatctgtatagaagtaggccagaaacaaggtagcggtttgccataccatggaactggcggcatcaccgatgccgtaaccaattttatcttttgttttaagcacagacgatatagtcattgttatgagccttataattaggtaaacaccttgatcagtcagctatccacggcctgtatggacaggcaggtccggctcaagtattagtaatacggccctgtgccaacaattccagaaattaacagccaatttatgatatttggtttttttaccgctttgtgatgcaggccatatagataaccaataaatcaattaatgttgagcgacatatttatgacattcggcggggttactttgttaaaaaccggcaggcgtcccatataaaattggtatgacacgggaatatgcactattgaaatagtacagggcagtgactatttgtattgttttctgttgcgttatggcaaataatatcccctcagggagaattttaccgcttgagatgcgttatcctgcccattgacagacagagaatccctatttcagtcgaataaagtgttatttagctgaacgtcagcgcgaaaagttagtaaaatcagtacaggatagccgtgagggccgcagtaactttttagaggaaatggaatgcttgaactgtttgacgtcagttacgaagagctgcaaaccacacgttcagaagaactttataagctcagaaaaaaaacttttagcgaccgcctgggatgggaagtggtatgcagccagggcatggagtcggatgagtttgatgggccagggacgcgctatattctggggatctgtgaagggcaattagtgtgcagcgtgcgctttacccgtctggatcggcccaatatgatcactcacaccttccagcactgttttaacgacgtccccctgcccgcctgtggcacggaatcaagccgctttttcgtcgataaagcacgcgcacgcgaactgctgggtgaacactatcctataagtcaggtattgtttttagcgatggtgaactgggcgcaggataacgcgtacaaccatatctatacgatagtcagccgggcaatgctgaaaattttgaaacggtccggatggcaaatcagcgtcgtcaaagaggcttttctgactgaaaaggaacggatttatctgctgactctgccagccggagaagaggataaacaacaactgggtggcgatattgtctcacgtacgggctgtgcgcccgtcgcggtaactacctggccgctgacgctgccggtctgataaggtctaactccacacccagtcttatagcctgtcgggcgttactgacgcccaatttaaccacgacgtttttgatgtggaacttcacggtgctgacggaaataccggtaatggcggcaatttcagaataggttttacccatgctcgcccagtacaacacttcattttcacgcgacgaaaaaatcgttttgtcggcgttctgatttaccgccggtgccctttcggcttctgtcccggccagtcgatacatctgctcattaaaatcaatcaacagcatctgcatggtgccctgctcagacgcaaggcgctgctccagggctgcctgatcgttgcccttaataatgacggagagcaacgcgaggttgttcatatggtcatggagcacgtaggtaaagccattaacgatgttgtactgctttgataatgagaaaattttggtaaaccgcagatcggacatcagggtaatgttttcatcccaggcaaacggcgaggtccgtttgaaggcggtgaggatgaccggatcggttaactgaaaattgttggcacggtataacctgacccattcgtcaggataactggaaataatcagaacatttgaaggattttttttgctcaccaccgtgtaagcgtactcaggactgccaagcggagataactttctctgtatgtaagtctgaagcgtatccattattgtttgattttcaagaaaaaaagaaaacattcaggctccatgctgcttcttttacttaatgatgacataacctgcactttagtacaggtaagataatacttaagaataacttacaatgattcatccagaggttacaatggcttcaagttgtttagcggtaaaaaaaaacctgacctgcaaggccaggtcgctaaaacagccaacaccagggaaaaactttccggccagacgtcacaaactataaagtggtgctggccgggacactcatagtaacatcttagaaacatttgtacaaacatttaacatcactgcgcattgctttattctcctccttaatctcctttaatacaatcgcttattcatccccgtcataactgcccttttctcaatagcttagcgttagcaacccgcgattattcgtcgctgctgttctcctccatttcgtgcctgcgcctgtcgccaaaatagataatcgatatattctgctattaccgctgcgcttagcggacattacgtcggggaatttgtctgataaagtccttttttaactggcttcgtgcattaaataagcagttgaatgtgacaaacatcacatctgtgccaggcttaagttcctgacaacagttcaaggagctcactatgacgacgtcaaataaatcaattctcgacccagatcgctttccgaagccgccattcaggcagcagccgcaacaggcacccggactggccagtgaaatggaccctgctcccgatcatggtgaaaaaagctatcgcggccacggtcgtcttaccggacgtaaagcgctgattaccggcggcgattcaggcattggtcgcgccgtcgccattgcctatgcacgtgaaggggcggacgtagccattaactacctgccggaagaagagtcagatgcggtggaagtggttaaactgattgaggccgaaggtcgtaaagcggtggcgattcccggcgatctgcgttccgaagctttttgtcagaagctggttaaagaagcggctgagaaactgggcgggctggatattctggttaacaacgccggacgtcagcagtttaatgaatccattcggacgctgagcacagaagactttgatgccaccttcaaaaccaatgtctatgcgccattctgggtaacgaaagcggcactggcttatctgccgcgcggtgcatcgattattaacacctcttctgttcaggcctttaagcccagcgatatcctgctggattatgcccagactaaagcctgtaacgtggccttcactaaggcgctggccaaacagctcggcccggaagggattcgcgttaacgcggttgcccctggcccttactggacgcctctgcagccgagcggcggtcagccacaggagaaagtggagcagtttggtgccgatgcaccgctaggccgtccaggccagccggtagagatcgccccgctctacgttaccctggcttcagatgaatgcagctttgcatctggacaggtatggtgctctgacggcggtaccggtacgctctaatccgcattgatcccctaatggccgcgcacagcggccatttttttagtctctgcgttactgcatggcctccaggatggcggcagccgcttttatccgcgccgggttggggtagtttttattcgccagcatcacaacgccgctgttcaactgtgggataaaggcaatgtaggcaccgaatccgtttgtggagccggtcttatgaatccagctggcacgatccgccggtttgggcgggttcaacagcgttgccggttgtgcctgtagcgccatgttgttgtcgctggcgtcaacgatcgtttgggtagccatcggccagggatagatttcccaacccagcccctgagacagcttgcctgccgttaagtagcgcgactgtgccgtcatcatgccatttcgcaaaacggtattaccggacgataatccgttcggatttgcattggcctgcataaaggtcatcatgtcgcgcgcggtagacttcacgccataggtttctgctgacagcataccgggcgagacgcgcaccggctgtccgtctttatatccccacgcatagtcaaacatcatggaagccggaaccctgtaaaaggtgcgcgtcagccgcaatggcgtaaagacgttcttctgcatcgcctcttcaaactcaccttttatcatcaaatatcccagcaaccccaggctgatattggaatagcggcgctgcgtgccgggcgcggcgtcaggctgccactgttgcaggtaagtcagcaacgtatcctggtcggtcacgctggcgggaagctgtaatggcatgccgccagcactgtaggtggcaaggtgcaccattttaatcgcctgccactgggggcctttcagggcgggccagtacttttgtaccgggtcgttgagatgaagttggctgttacgcatcatcacgcccgccagtaagccggtaaacgttttgctcacagaacccagttcaaacaacgtgttttcggttacgcgtcgatcggatgcggtatcggctacaccaaagttcaggtattgcgggcggcctttatacagcactgcgaccgacatgccaggtatcccctcctgctccatcagcggcgtaatgatgttcttcacccgcgaggcaatgtcctgcgaggataaatctgcagcgctgctgctggcgctaagggcgacaagtaatgcagtaaggtatcgtttcatcagcactcattcaggtggcaggttatttacattgagccgcgcatgattgcacgcaaagctgtgcctgggtactgcaggcaccggaattacgcgtattacaatgcgattgctcaacataacaacgcgtctgacagctggagagatcacattttgcggcgacgggcgttaactgaggtaacggcgcgcgtgaggggaacgtaggtgcgggttgtgacaatgcgctgctgaccatcaggccggacagcagcaaagcaagcagatatttcataaccgatctccagagaaacgcgtcagttaagtatggtgactctggcgcgtaacgtctgataaatcttactaaattgagatcgcgggtggatgttcaacaacatcgacgacgccacgacgataaatttcgttaaggcgcgcgcaatactggcgcggatcgtgctgctgtttaatgcgtaaaatcgatccttcagccttttccgttaatacctgtggatgcgccaggatatccagcagtgttgatttcaggccgtcaattaacgcccggcgcagacggtgtttatcggcttcgctgttgacctgatattcgcgatcgtcattcagcgtaccgccgatcgtccagcctgcactgtcggggttaatttccggcagcgcgcgcacattactggttaataccgggcaaccgctcgcctgcatttccagtaccgaaaagccataggtttcctgccaggtgggtaataagccaacatcgctgcgctgaaacagtttcaacagttccggattcgccatctgagagtgatgggtaataaagctgaggcgggaaatgcgatcctgaatagtgcgataaaaggcgtcatcgtcctggaactgacggtgtgccacattatgccgcttattcaggtcaccaataagctgaacgtctagctgcgacgcatcaatctggccggcttcaaccagttcgctcagcgccagcacaatttctgcgccgcctttgcgataaaactcgttgccgacaaacaccagacggatgttgtcactctggcgtgcagttttttctggggtaaacaacgtttgcggcggatgcatcaccagggttttggcacgcatttttgcggcgacatcgggtttaaacagcttcatctgaatatgaagcgtggcctctgaaatggcaatcaggccgaaacagttgtctttcagtaaatacggaatcaggcgctttaattctgggttgtcctgtttggcaacccccgccaccggcagcacgcgcggcagttctgtttcaaatgtcgccacccagttcatctgggtgatcgccacttcattaaacagatgcaaaatatcgggcttctgccccattgcaaatggcacaggtaaaaagacaaagcttttatttttttcaataaacgggtacgcagcggattgaggaaatagaaaacgttacgttttttcaggttgatatagtcgttttccggattgaccaaaatattgcgctgctccggatagtgattgttacttattccgattttcatggaggattccgaagtcattgtgagggcgaacgtgatctatatcacgctaaatatgaaacggattataggtaacatcttaaaaacgcagggttactgtggtttacagatttctctgcaccggccaggtgcagatcgttgcacagcgaccgtgcatcgactgaggttatctgttgtgttatcccgacagattcaggcatccggcccttttcgcttctggtacaaaagttgcaaattactgatatgtacacaggagataacatatgaaagcgatcgtcattggtggcggaatgggtgggatgaccgccgcactggctctggaacaggccggtttcgaaactgaagtttatgaggcggtcaaaacgatacggcctgttggcgcggcgatttctgtctggccaaacggcgtgaagtgccttaatgcactgggactgaaagaaaaagtccgcgctctgggcggtaacatggcgtttatggcctatcaagacgcgttttcgggtgacacgctgacccgctttagcctgtcaccgctggtgcaacaggtgggcgaattcccttaccccatcgcccgcgcggagctacaggcgatgctgctggatgcttatggccgcagtcgggtaaattttggcaaacgtatcgtccaggtggagcagtacgccagcggcgttatcgccacctttgacgataacagccaggcgcaaggcgactttctggtcgcggcagacggaacgcattcggtgatccgcgattatgtactggatgaaaaattgccacgccgctacgcgggctatgtgaactggaacggtctggtcaggattgatgagtccatcgcgcccgctgaccaatggacaacctttgtgggcgatggcaagcgcgtttcactgatgccggtaagcggtaatcgtttttacttcttcttcgatgtcccgctgccttccggtctggagcaggatcgttcaacgatgcgggacgatttgcgccactacttcagcgactggtctgaacccgtgcaaaagcttatttcggcaattgacgtggacaccaccaaccgggtcgaaattcacgacattgaaccttttcagcgttttgttaaaggccgggtggtattgcttggcgacgcggcacacagcaccacgcccgatatcggccagggcggttgtgcggccatggaagatgccattgtgctggcgtccgcgctgtctgcgcattcgcttggcatcgaggatgcgctactgcgttaccagatgcgccgtgtcgagcgcgttaaggatttggtgttgaaagcgcgtaaacgctgtgacatcacacatgctaaagatccccaaatgacctcggcgtggtatcagtcgctgaagacggaaacgggtgaacgggtactggctgggttgtgcgaaaccattgaaggcggtccgttgggttaataaaacagggcggcatcgccgccctttcgcttcttgcttattccgctaagccgcggtttttcaacataggttcgagctgcggctcaccgccgcgccaggcttcatacaacgctttaagatcgctgctgttgccgcgtgacaaaatcttttgtcgaaagatatcgccattttcccgcgtcaagccgccctgttcgacaaaccactggtagccgtcgtcggccagcatctgggtccagatataggcataataacccgcagaatagccgccgccccagatatgctgaaaatagctggagcgatagcgtgggggaacggcagccaaatcaatatcgtcgctgcgtaacgcctgctgctcgaatccgtcaacggactgcatcggcgttcgaccgtcaaggctgtgccagtgaaggtccagtagcgcggcagccagcagctcggtcatctcataacctttgttgaatttgccaaccctgatgattttttcatgcagcgccgccggcatgggttcgccggtctggtaatgccgggcgaaatggcgaaacacctgcggctcacttgcccagtgctcgttaatctgcgaggggaactcgacgaaatcacgcggcgtttccgttcctgacaggctgggataacgctgactggcaaacaggccatgcaacgtatgaccgaactcatggaacagggtaataacctcatcccagctcaggagtgcgggctcaccgtcggcgggtttggtgtagttacagacgttgtagatcaccggtttggcgtcgagcagcgtggactggttaacaaagttgctcatccatgcgccgccgcctttactgtcacgcttgaagaaatcggtataaaacagcgccatcccactgccgtcaacatcaaagatttcatatacctgtacgtctggatggtaaaccggcagatcgtgacgcggggcaaactgaataccatagagctgggtcgcagcccaaaacacgccattttcgagcaccgtgttgagttcaaaatagggtttgatctggctttcatccagatcgtactgtgcccgccgcacctgttctgcataaaaattccagtcccacgcgctgagcgtgaagttgccctgctggctgtcgatggtttgctgaatggccgaggcttcccgctccgcacgggctcgggcggcgggaacgatattacgcataaaggcgaaggcagcatccggggtttttgccatctgatcctgtaactgccaggcggcaaagctggcaaatcccagtagcttcgcctgctcagcgcgcacctgtgccagacgcaacaccagcgctcgcgtgtcgttgtcatcgcctttctcactgcgcgtcatggcggcatggaacaaggcctgccgcgtcgcgcggtcttccagagactgaagcgcaggctgttgcgtggtattttgcagtaccagccaccaggcattctccaggccacgcgcgcgggcagccgcctgggcgacggccagatcggacgggctcagccccgcgagttgctggacatcattcaccatcaacccgcccgccttggtggcagccagcagcttgttggtaaactgcgtgctgagtcgggccgcttcctggttcagcgcctttaactgctgcttttgcgcttccggcaggttcgcccccgccagctgaaagcgctgccatagcacgtcgaccaggcgtttcgattcggcatcaagttggttgcgctgcaaatagacctgatcgatgcgtgagaacagcggccggttcagcatgatctcatcgtttagtgcggtgagctgtggcgcgatgtcctcgtcaatctgctgaagataggggctggtatgggcggaggtcatcgcgttgaacaccaggcttacgcgggtcagcagttggccgcttttctccagcgcctcgcaggtgttaataaaagtcggcgcatcaggatcggtggcgatggcctgcacttcctggcgcttttcttcgataccggcctgcagcgcagggagaaagtcggtttcctgaatctgatcaaagggtggcgtgtgataaggcaaactgctgacgctaaaaaaaggattttgacgggcgttcataggcgctcctggagaacaacacagagtctcatagtggcaggttgcctttgacagaacaacctacccgcgtggttgttgatacaccgcgataatttcacccgcaatcgcgacggcgatttcggcgggcagcttccctttgacatcgggtaagcccatgggacagcgcagtcgcgccagccggtcttcgccaatccctttgccttccagccggtagcgaaagcgctgacttttgctttgcgaaccgatgacgccggcatagcgaaaatcaccccgccgcaggatagcctcgcacagggcaagatccagcggatgatggtgggtcataacgatataatagcttccgggggccgccccggccacgcagtccaggggatcgtcgggctgctggacgttgacgccaggcggcaccgacgcaaactggttatcccgactgtcaatccagttaacgtgacagggtaacgtagccagcaggctaaccagcgcctgaccgacatgaccggcaccaaacaccaggatttctggctgcgcctgcatgagcggttcaaacagaatcgtggtcattccgccgcagcactgccccagtcgcgcgcccaggctgaactcttcggtatggggacgccgctctccaccttctaacagcgcccgtgcctgagcgatgcactgaaactccaggtgaccgccaccgatggtgagaaaggtttcactgtccgtcaccaccatcttggcaccaccgtcacgcggtaccgagcctcggtctttcagcacggtgatcagtacgcagtgttgccgcttctggcgcaggtcgtgcagaatggtaatccagtcatgataaatcatccgcgcctccggtcatgcgctgtacaccccagaatacccgctccggcgtggcgggcgcatccagcccgggatgcaggcgataaccggccacgctggccaccgcatcctgcaatgcacaccaggcggcaatccccagcatgaaaggcggttcgcccacggctttcgaatgaaaaaccgtgtcctgcgggttcttgcggttttccaccagggtgacgcgcatgtcggccggtacatcactgatggcaggaattttgtagctcgcggggccgtcagtcatcaactggccgtggtcattccagaccagttcttcacaggtcagccagcccagcccctgtacaaatccgccttcaacctgtccgatgtcgatagccggattcagcgacgcgcccacatcgtgcagaatatccgcccgtagcagccggtattcacccgtcagcgtatcaataatcacctcacagcaggccgcaccgtaggcgaagtagtaaaaaggttcgccgcgaccggcctggcgatcgtaatgaatgccgggcacgcgatagtagccggtagccgaaagcggcacctggttcagccaggcaagctgggcgacctgagcaaaggtgtaatagtgatccgccgcccgaacgatgccgttgctgaaattcaccgcatctggcgcgcacgcgtgcagcgtgcacaacatgttcgtcatgcgctcacgcaggatttcggcggcgttctgtgccgctttgccgttaagatctgtgccactggacgccgccgtcggcgaggtgttgggtactttacccgtatcggtggcggtgatttgaatgcgatcgacctcaatttgcagcacctgggcgacaatctgcgccactttggtgttgagtccctgacccatttccgtcccgccatggttgagctgcaccgtaccgtcggtatagatcagaatcagcgccccggcctgattgaggaaactggaggtaaaggaaataccgaatttaaccggcgtcagcgccagtccgcgtttcagcacgggatgcgtcgcgttaaacgctgcgatggcttcgcgccgggcataatagtcactgctggtttccagctgcgccgtaatctcatccagcagattgtctttcacctgctggtggtaatgggtgatattgcgctcatgtttgccgtaatagttacgtttgcgcagcgtgagcgggtccagcccccgttcacgggcgatgtggtccatgatttgttcgatggcgaccatgccctgcggaccgccgaagccgcgaaaagccgtattggatgcggtattggtgcgacaacggtagcccgtgatcaacgcatccccaaggtaataggcgttatccgcatgaaacatggcccgatccactatcgatccgctcagatcgagcgagtagccgcagttcccggcaagatcgatttttacaccgcacagccgtccgtcgtcgtccacacccacatcgtaacgcacataaaaaggatgccgtttgccggtaattcgcatgtcatcgcgccgggccaggcgcattttaaccgcgcgcccggtcaggttcgctgcgatcgcgcacaggcaggcaacgctcgccgcctgggtttctttgccgccaaatcccccgcccatgcgccgcatatcaatcgtcactttgttcatgctgatgcccataacctctgccaccagcttttgaatttccgttggattttgcgtggagcaaaagacctgcagcgcatcgtcttcaccggggatgaccatcgccgtctgggtttccagataaaagtgctcttgtccgccgatatgaaatgcgccctgaacgcggtgcggggcacgcgccagcgccgcctcgacgtcaccgcgctggtgaatgtggggttcctggacaaagctgccctgttgcagcgcctgttccacgtccagtaatgcgggcagaacctcatactcgatgatggccgccatcgcgccctgcctggccgcgtctggggtttcggccaggacggcaagaatgatctgcccaacgtattcgactttttcctgcgccagcagcggatcgccgggctgcagtggcccgacgtcgtttaccccgggcacctcttgccaggtcaggacgcgcaccacgccgggaatggcatagcacggctgcacgtcaacatgcatgatgcgggcatgtgcatgttcactcaggcgaggacagagatgcagcaggccgggctgctccgctttatcatcgatatacatcgcttcgccagacacatgtttatcggcgctttcatgtttattgctgcgccccacgccgctgctgatgtcacgcgcatgggcaatgggtaaggcggaatcgggcaatgccggacggttatgagacatagcggcttacctcggtaatggataatccattcagacggtagaaataacggcgcagcaggttgcccgccacctgcaggcggtaatcggcactggcgcggaagtcgctgagcggctggaaggtttctgccagcgcctggcaggcctttgccatcgtttctgcggttaagggtaatccgacgatggcctgctcacagcccgccgcgcgtactggcgttgccgccataccgccaaaggcgatgcgcgccgcggtgacaatgccgttctcggtgtggatgttaaaggcggcaaacacggccgaaatatcatcatccaggcgttttgacaccttccaggccacaaaaccaggtgacaccgtcacttttggaatgatgatgctatgaataaattcccctgcctcgagcacggtttggcggtaatcggtaaaaaagtcgtcgagtgacaaggtacgttgcgtgttgcctttctgcagaagcaaggaagcatttaacgccagcagcgtaggtgaagcatcgccaatcggggacgcattcgcaagattaccgcccagggtgccgagctgacgaatttgcagtgaggcaaaacgcgtcagcatctcggtcaaacccggtatgcgcgtcgccataaaattggcgattttttccagcgaggccgcggctcccagccgataatacgcgtcatcctcatggcacactttcagcgcatcaacctgtcctagcgcaatcatcaacggaatgctctggtaacgctgggtgatcagcaggctgagatcggtgccccctgccagcaacgcggcgtcgggctgcgccgcgtagagcgtggcgagctgttcaacggttttggggatatagcagtagcggcctttgtcctgcaccacctggacttcctggctgtccagcgcggtcaggcgctcaactaccttctcttcctgccgatcaaagcggtcaggctgcggctgcgtcaccacctgctcggcggctgccatgatggaacgatagccggtgcagcggcacaggttgccggccagcgcgtgctctgcctgttgacgatcccagccatgattgtttttctgcaaactgaacaacgacatcacaaaacccggtgtgcagaagccacactgtgaactgtggcagtccaccatggcctgctgagcgggatgcagggttttgccctgacgtaaatcttcaaccgtaataagctgtttgccctgtaatccactgaccagcatcaggcagctgttaacggtctgatactgtaattttccgtctaccacactgcccagcgtcacgctgcaggcaccacaatcacccgaagcacagccttctttggttccacaacggcgcttgtgggttcgcagataagacagcaccgtcagattaggatcgatctgttcttcggtaatcggtaaatcgttaagcaggaactgaatcatgcggcattctcccttgtggcggattgccagactggctgaccgttaacccaggtctgaacgatgtttctgtcatcgcccagggtcatcagcacaaacagtttctcccagatatccttgcagttactcatgcgcagcttttgcaacggggaaacggccatatccagcacgacaaaatcggcttctttacccggtaaaaaattaccaatgtgctggtcaagatccagggcatgagcaccgcccagcgtggcatgataaaaggcttctgccgcactcagcctgtattgttgcagctggccgaccttgtaggcttcccccagcgtttgcagcatattaaaggtggttcccgcccccacatcggtgcccatgccgacgttgatgccctgctgccagctgcgtttgatattaaacaggccgcttcccagaaacaggtttgaggtcgggcaaaaggcaatggcggaatcggtatcatgcaggcactgccattcatgattttccagatgcaggcagtgtgcaaacacgctgcgacgaccggtcaactggtattggtggtaaacgtcgagatagccattgtggtcggggaacagcgctctcacccaggccacctcctgcgggttttcgctgaggtgcgtatggagccagacatcaggataggccgtacgaagcgtctgcactttttccagcaaggcgggcgaagacgtaggcgcaaaacgcggcgtcagggcatagcccaggcggccccgctggtgccagcgttcaatcagcgcacgggtttgctgatagctttcttccggcgtttcgacgaggtaatcgggggcgttgcgatccatcatcacttttccggcaatgatgcgcatattcagcgcttcagccgcgctgaataaagcctctaccgactgaggatgaaccgtgccaaagatcaacgcactggtggtgccgttggccagcaactggtgaagaaaaaacgccgacatttgcgcggcatgttccgggcagcggtactggccttccaccgggaacgtatactgattcagccattcgagaagctgttcaccaaaggcaccgatcatttccgtttggggatagtggatatggcagtcgacaaaacccggcatgatcaacttaccgcgcaaatcgatcacggcgtctggacgcaggctgtccctcacctcatgccagtcatgcagcgccacgacgcggccctcacgtaaaatgagcaggccatcgtcgatataacgcgcctgggctaaaatagcctcaggatcttttgccacgtcgacgaaatcgaaaaagctggcgcgaatcgctgtgtccgagcttgtaaacatagggtttcctcttaccggacgcgtcatctcgtcgtcctgttcctttaacactctctataggtaatcactttgcaagagtcgtgccagcagcagtttaattaaaatcctttattttcataaagatagatggatttatttgttgcgcaacatttacgctgacaaattctccacgcaaccgattgctcactcaaggcaatcggttgctaagccatctgccgcctgaatgcttccccggcagcgtcgggcactgcacggtttcagtgcagcctgcgctaaaacagcgcaacgtcgcggtcatcattacctcagaattcaacgggcatacgcaaaactgacatgctaaggtgatgcaaacaccacgaaacgggataagggaaaagcgagatgattatatttgttacgggggccaccgcaggatttggccaaagcattacccgccggttcatcgaaaccggtcataaggtcatcgccagtggacgtcgtgcagaacgcctgaaggcgctaaaagcggaattgggcgacaatctgtataccgttcagttagatgtgcgtaaccgggcatccattgaagaagccatcacgcagttgcctgatgcgtggcgtcatattgatgttctggtgaataacgctggcctggcgctgggcatcgaaccggcgcaccgggcagatgtgaatgactgggaaaatatgatcgacaccaataccaaagggctggtctatatgacgcgcgccgtcttgcctgccatggtagagcgtaacgtcggccacattattaatattggttccattgccgggagttggccttatgccgggggcaatgtctatggggcaaccaaggcatttgtgcgccagttcagcctcaacttacgtaccgacttgcacggcacggcactgcgcgtgaccgatattgagccgggcctggtcggcggtaccgagttttccaacgtgcgctttaaaggcgacgatgacaaggccgatcgggtttacgaaggcgcgacagccctgacgccggaagatgtcaccgaagccgtttactgggtggcgacactgccgaagcacgtcaacattaacactctggaaatgatgcctgtcagtcagaccctggcgggactgaaagtccacaaaccctgatcgcagcgccagccgcccgggctggcgtttacgctttgccccagcccaccacgataattaccatgccgctcagagcaatgagtgcgccactccagtcccatacgctcagcctgaccccgtcgactacgcgcagccacagcaacgccgtcagcacataaacgccgccgtaagccgcataaacacgtccgctggcggcaggatgtaaggtgagcaaccagacaaacagcgccaggcttaatgcagcaggaaataacaaccagacagaggcgcccttcttcaaccagagccacggcagaaaacagccaataatttccgccagtgcggttataaaaaacaggaaggtggttttgagcagcacgataatctctctgacaggtaaacaacatgcacacaactggtgagcaagtaatcgtcaatggtatactatcctcatttgatgcaatagttttacccataggtaaaagcagagttaatcgaaggatattacgatgaaaaaattggttccggttctgatggtggccctgctttctgcgaccgccctgtctgtgagtgcagctaccgatcacctgattattgaaaacggcagcagcgcgctgaataacgaagcggcacgccagagtaaagagcagtggaatgatacgcatatgctgcgtaataaagtgaacaatcgggtggaaaaagagttcgataaggccgatcgcgccttcgacacacgggataagtgcgaacaaagtgctaacctgaatgcttactgggaaccgaacacgctgcgctgtttagatcgccgcacaggccgcccggtactgccgtaaatttcagctatagtaatgactgacgcatgacaaaaggaaagggttatgaagatcaagactgcattactgacagcgacgtttttggcattccccttgctggctcaggcatcctgcgaatctgtaaaagcggatatcagccagaaaatcattcaaaacggtgtgcccgaatctggctttagccttgacgtggtcgccaacgatcaggttgatcaggcgggcggtcaggtggtcggccattgcgacaacgacagccagaaaatcgtctataaaaagctgggccgcgatgaaggtgcatctgtgccggacagcgcaggcagctcgcaagatacctcaacacaataacgttcagggcgacgataactgtcgccctttcttttgccgcgctatctctctgaccgcctgtcacgcaacgcgttactgctgctcccgccttattcagcctgctgtggctgttggcgcggcattttccatgctacccacatcgtcagtaacgcaatcaccaacgccacgataaataccgagtgcagcgatgcggcaatggcctgcagcatatgttgcagaacatcgggggccagccgatcgcgggtttcctgtgacatgatttgctgaaccgggtcctgcgcctgcggcagtcgccactgcagattcagattcagcacggcacccatcaccgccgtacccaacgccgaaccgatcatgcggctaaacataaccgacgcggtacagataccgcgcacgtcataatcggcatgattctgcacggacaccagaaacgtcgtgctggtcattcccatgccggtgccgatgacaaacgccgtaaatccggcctgaaacagcgagctttctctgtgtaacagcagcagcaaggcgctgccgctaatcagcaacagcgcgcccaacagcgcggtaaagcggtaggatgtcaccagcatcaaccggccactcagggtgcttgccagcggccagcctatcgacatcatcgccagcgcggtccccgcctgaagcggcgatcctcccgtcacgccctgaatccaggtcggcagaaaagcgctgacgcccatcatggtcgcaccaatcaccagattgcctaagtttcctgcgatgataagccggctcttccagatgactaacggaaacaatggcgaccgggtgcgctgctcatggcgggttaactgccagcccgccaccaggccaatgagtaaaaacagcaacagccagtatcccaactgctccgcctgcaacagcgcaatcagtacggcgctgatgcataacgtcagccagccgctgccggtcagattcagggactgagacggctgtgctttctgcgggtgagcgggcaacagcgccgccagcatcagcatactgatcatgccaatcggtacgttgacccagaagatcactgaccagctaaagtgctgaaccagccatgcgccagacaacgggccgataatggcggcgacgccccacacgctggacaaccagccctgcacgctggcccgttcacgcggggaatagacgtcggccacgatggtggaactcagcggcatgatggcaccggcacccagcccctggaaggcgcggaaaataatcagccaaagcatactttgggcaaagccgcagagcacggaccccataagaaagaggatgatgccaaggaacagcatcttttttcgtccccacaggtcggccagccgtccatagagcggcacgcttaccgcctgcgtcaggagatagaccgagaaaacccagccgaactgcgaaaagccgcccaggtcagccacaatagtgggcatcgcggtcgccacaatggtgacttcaatagccgccataaacatcgccagcatacaggcaagaagaatccagtgacggcgcgatggtgcggaggtgctgttggtcatgatgctccctttttgagtcctctaaggctagcgcaaatttagcgcgacaggaatcacttcagcttaatatgtgacaccgtcacctaatagatgcgtttttaggtagtttcgctcttaaaccagttgctataagggctcaggcgcttttgggctattcctatcttcctgatttttccgataaaaactggcgcgcttcgcttggcgctgctataggaataaagctgtattttctgcagttgctgaaattacgcagaaaatggcagcggttttcgatctttagcgacagtcatggttttggaagctgcaatcaatttagccgcttttgtcatgctgttttgggtatgtataacaacagatctgttaacagggagaatccatatgcataacgcttcactggccaaacgtgccggtcttgcgctgcttgctgttgtagcagtgttgggcgcactggtctgggggcttggctgggatacactggtcgcccgcagagtcgatctgatttaccttggacagcagcacctgtttttggtgttttggtcaatgctgttcgcgctgctggtcggtattcccagcggtatcctgctcagccgcccttttgcacgtcgctgggcggaatacgtgatgcaaatctttaacgtcggtaatacgctgccgccgctggccgtactggcgctggccatggtggtcatcggcatcggtgacaagcctgccctgatcgcgctgtttctggcctccttactgccgattgtccgtaacacctattccggactcagcgcagtgccgccttccctgctcgaggcggcaaacggcatcggtatgaccaagtggcaacgcctgcgtcaggttgaaatccctaacgccttaccagtgattctggccggcgtgcgcatcgccacggccattaacgtaggcaccgccccgctggccttcctgattggcgccagcagttttggcgagctgattttccccggcatttatcttaacgacttccctgtgcttattctgggtgcggttgcaaccgcgctggttgcactggtgctggatatgctactggcgtcattagggcgctatctcagtccgcacgctgcggcataacaataaggggtttgtaatgctaacgcgctggattaagagttgtactctggcattgatgaccacgctggcactcagccagaccgtacaagccgccacaccgctggtgctcgcgactaaaagctttaccgagcaacacattctgtctgccatgacggtgatgtggctgcaaaagaaaggctttgacgttgtcccgaaacgcaacatcgcgaccaccatcagtcgtaatgccatgatcaataagcagatcgacatgacctgggaatacacgggtacctcgctgattatcttcaaccatatcaacaaaccgatgtcctctgaggaggcttacaacaccgttaaaaatctggatgccaaactgggccttatctggctcaaaccggccccgatgaacaacacctatgcctttgccatgcagcgcgcccgggctgaaaaagaaggcatttctactctgtcgcaactggttgcaaaaatggaacaggtgcgaaaaacggacccgaaacacaactggcgtctcggtctggacctggaattttatggccgttccgatgggatgaagcccctgcagaaggcctataacctgacgctcgacaggccacagattcgccagatggacccgggcctggtctacaacgctgtacgcgatggttttgttgatgccgggctgatttacaccacggacgggcgcgtgaaagggttcgatcttaaggtgctggaagacgataaacacttcttccccagctacaacgtgacgccggtggtgcgtaaagacgtcctggagagccatcccggtcttgaggcggcgctgaatcagctttccccgctgattaccgacgaggccatcaccgagatgaacaagcgggtggacatcgaccaccagtcacctgaacaggtggcgcgcgatttccttcaatccaaaaacatgctgtaaggaggcatcatggatacccttcattacatcattgataactggaataacctgctcacgcttacctggcaacatacctggctggtgctggtcgcggtgggatgggccattgtgattggcgtgccgcttggcattttgattgtgcggttcaaatggctggcaacgccggtgctcggggttgccacgattgtactgaccatcccaaccattgccctgtttggcctgatgattccgctgttctcccttattggtaagggaatcggtgccttgcccgctatcacagcggtgttcctctactcattactgcccatcgtacgtaatacccacaccgcgctggagaatctgccagatggcctgcgtgaagccggtcgcggcattggcatgacgttctggcagcgcctgcgttgggtggagattcccatggcgctcccggtgatcttcggtggtatccgtaccgctgtggtcatgaacgtcggcgtgatggctatcgctgccgtaatcggcgcgggcggcctgggcatgctgttgctggatggtatcagcggcagtgatattcgtatgctgatcgccggggcgctgatgatttgtctgttggctattgttcttgactggctgctgcaccgtttgcagctggcgctgactcctaagggaattcgataatgataaaacttgaaaatctgacgaaaaccttcagccagaaaaatggcacgctgatgaaagcggtggacaatgtgagtctggaagttcccgccggagaaatgtgtgtgctcctgggcccttccggctgtggtaaaaccaccacgctgaaaatgattaaccggttgattcccgccaccagcggccggattttaattaacggcgaagataccagtacgcaggacaccaccaccctgcgccgcaatatcggttacgtgatccagcaaatcggcctgttccccaatatgacgattgaagagaacattaccgtcgtgccacgcatgctgggctgggataagaagcagtgccgcgagcgggcaacggagttgatgagcatggtggcgcttgatccgcacaagtttctgcaccgctatccgcgcgaaatgtccgggggccagcagcaacgtatcggggtgatccgcgcgctggcggcggacccaccggtgctgctgatggatgagcctttcggcgcggtagacccgataaaccgggaagtgattcagaacgagtttctggatatgcagcgccagttaaagaaaacggtgatgctggtcagccacgatattgatgaagcgttaaagctaggcgatcgtatcgcggtctttggtcagggcaaaattgtccagtgcgccagcccggatgagttgctggcaacgccagcaaacgagtttgttggctcgttcgtcggtcaggaccgtaccctgaagcgtctgctgttagttcaggccggcgatgtcaccgaccagcagccaacgatcacggtgaaacgctcaacgccgttaacggaggcctttggcaccatggacgacaacgacatgcgttccattaccgtggtggacgacgacggtaagccattaggttttgtgaaacgtcgcgaagcacgaaacgccagcggtcgctgcgaagagatgctgcatacctttaaagtcaccggcaaagccgaggaaaacctgcgtgtggtgctgtcaaaactctatgagcacaacactgtatggatgccaattgtggatgaggatggacgctacagcggggaaatttctcaggattatattgctgactatctcagctcagggcggacacgtcgtcgtctgaacccgtaacgaatcagggccgcaatcgcattgcggcccttttatgattgaccttgcttctcatcccatatcactgtctgttggtgctctcagacacatcacgtctgaaaaaataaagcgttctgattagcggactaccctgatattgcggtttatatcaggctatttttgcacgggcaaaatgcaggttatccgcattaagccgcgagatatcaagatatggcgacaggtcgcgttgctctgcgcgcggtaaataaggtaactcacccagaaggggcgcggaaatctgttcacgcaggacagcaatgatatcggcatagtgcgccagtccgggattaatacggtttgcgacccaacccacaagcggtaaaccgtctgccagaatcgcctcggccgtcagcagcgcatggctgatgcagcctaacttaataccgacgactaagatcaccggcagttgctgctcgaccacccaggtcgaaagcggttgcgtatcgttcatcaggctgcgccagccaccggtgccttcgaccaccacgcggtcgacaagctgattgaggtgctgcaacccttgggtgatttgcgcatagtccaccttttcaggcggatagccgcaaatctcctctttctcaaaaatcaccggattgacggcatgatacggcagcgcaagggaagaggcgttttgcaaaaataaaccgtccttgtttctcaggccctcttctgtcctgaccccgcagcgggcaacaggtttgtaacccgctgcccgctcgttcgcctgactaaaactttgtagcagcgcgcgtgagaccacggtttttcccacttcggtatcggttccagtaataaatagcgttttcactcgacttctccttcacaagcggtatgggctaatcgacgattaggctttcgtgcgaattaacattctaaggaaggaaaaggccgggcagattgcgttagcgcaaggttagtgatgcttaaccttgcagtaacttaactaacaggtaaccactgtagagtgaatccttgatcaaggcggcggcgccaagtgtgccaggctcagtaaattcagtcggtgctagctgaatttcagcgctgtaagcaggtaaagactgctgatgaatcgtgttctgtacggcgggaaataaaatatctgccgcctgatttagcggcgaacctataagaatttgttgaggattaaagatgttgaccatcatgcccaggattctgccaacgtgatgtcccaccgtcgcgatcgcatcccgggcgagccgatcgccggcctgcgccgcctcgcagagagcggaaagcgttaacgcctgatgatgtaacaggctgtcaggctggcctggcagccgttgggcgaccagcgccagcaggctgccggtgctggcaaccgtctccaggcagccgtgattgccgcagtagcactgctgaccgtaaggatcgacctgagtatggcccacttcgaccagcgcccgtccgcttttgtgcagcagttgaccgcccgtgatgacacccgcgccgacggtttcatcgatcacaatctgtatcacgtcctgtgcgccacgagacgcaccaaacaacgactcagccagcgtccaggctgagatatcatgctggataaataccggcagaccggtgcgtgccgccagggtgctgcccagaggcatatcatgacaacggtaacccggtaaacggtgcacgacgccggaggcggcattaatcaagcccggcaaggtgatggcaatcgcggtgagcctttctaactgcttctggtgccgaataaaaaacgcatcgacatggtcggtcagggtcgtcagcaacggctgtgttgggtcatcgggcaaaggcagatgatcctcaacccgcgccctgctgctcagatcacgtaaggtgagcgtcaatatgccacgatgcaaacggatagccagatagtgccaggcatccgtatcaagaatgaggccaatcgccggacgcccacgggcacccggctcctgaaactcggtttcctgaaccaggtgggcatcaagcatttcccgcacgatttttgtgatgctggcaggggccagttgggcccgttttgacagttcaatacgagaaatgggcccatgctgatcgattaaccggtaaacgccccccgcattaatttgtttgatttggtcaatatggccaggttgactgtccgaactcacaccctgctccggttattttcgcgcttctaaataaatatccgctatggtgcggcagattggcttgttacggcaaagatttgcttagatatgtgatttatcacacataatttttctgacattgtgggatagctgccctttagcgacgcagcaaagccatcatatgcgtcatctgcgcgctcatctctctttcacccgaccacaccagccacatctccgagagcgcatccggttccttaagcggcagccataccacattcgcgaggcgcgcgtggctgaatgacaaaggcaggatggaaacgcccagcccggtcgccaccagtcctaatatggtcatcgcctcgccgacttcctgagtgatatagggccggatctgatagcgctgcaggagatcaagaatttcgctataaagcgccgttcccacctggggatcaaaaaacacaaaaggttcgctggccagtgcctgtagcgaaatctgccctgctgcggccagcggatgcgctttatgcaccacggcacacagcggctcacgcagcaaaagctgatgatgcagatccgccggaagcggcgtgttacgcatcaccccaaggtccagcttcccttcatgcagcggagccaattgctggcgggtattaatttcctgcatctgaacatgcacctcaggccagcgctgacgaaaccgataaagcgcatccgacatcacgccgataaaagcagcagaagaggtaaaaccaatgcgcagctccccctcttcaccgcgatgcaaacgcgcagcgcgttgcgttgcctgatcaacctgcagcaggatggcccgcgcgtcctgtaaaaactgctgtccggcgggcgtgagctgcacgctgcgattggtgcggttaaagagctgcgcgcctgtttccgcctcaagctgcataatttgctgactcagcggcggttgcgagatgtgtaagcgttgggctgcgcggccaaaatgaagttcttccgcaacggcgatgaaataacgtagatgacgcagctctatattcatatgttaaacatcttatttgagattattaatatattagacaacctaatctgccttttctagagtaacgctatgtttttactcataaggacccattgtgaatcgctcctcacctgcgctgccgctggacagaaacgtgccggaacagtctgacgttcctgcgtctgacggcatcgtgcgcggcacacgcccgtttatgcgcgttacgctcgccttgttctctgccgggctggcgacctttgccttgctctattgcgtacagcctattctgccggtgctctccacacagtttggcgtttcacccgccgcgagcagcatttctttgtccatttcaaccgcgatgatggccctggggttgctggttactggcccgctgtcggacgcgataggacgtaagtccgtgatggtgacggcattaatgctggcgtcaatctgcaccctgctgtcggccaccatgaccagctggcacggcattttgctgatgcgggcgttaatcggcctgtcgctgagcggtgtggccgccgtggggatgacctacctgagtgaagagattcatcccagtgtgatcgccttttcaatggggctgtatatcagcggaaactcgattggcggtatgagcggccgtttaatcagtggcgtgttaaccgactttttttcatggcgcgtggccatcgcggcaattggctgctttgccctggccgccgccctgatgttctggaaaatcttaccggaatcccgtcatttccgtccggcctcgctgcgcccacgccatctggcgatcaattttcggctgcactggcgggatgcgggattaccgctgctgttcgcagagggcttgttattgatgggggcctttgtgacgctgttcaactacattggctatcgcctgctgggcgcgccctggcatttaagtcaggccgtggtgggattgttgtcggttgtctatctgacgggttcatggagttcgccgaaggccggggcattaaccaacaagtttggtcgcggtccggtgatgttgggttctaccctgattatgctgacaggcttactcctgactgcctttaacgccattgtgctggtgtttgtcggtatgatgctgtttaccgccggttttttcgccgcccacgctgttgccagcggctggattggtcctcgcgcccgccgggcaaaaggtcaggcctcttcgctgtatttttttagctattacgtgggctcaagcgtggctggcacggcaggcggctttttctggcatcagtttggctggggcggtattacgctgttcatctccgctttactgctggtggcactgtgggttgcctggcagttgcacaggcgcaaactctagcaaatcttaataaatattccgggtggtttgctgcccggaatgcctcctgtacaagaattgtccgtattatcagcgtgattgctgatttcatgcgtttccccgctatactcgttttgatcccaaagattaatgtaatctttgaattcacagcaaaggggagacctaatggcgcgttactattacgtcaacaaacaatcaggctacaacaataatcatgttgtgcatgcaaatggctgtaaataccttccggacctggaaggtcggctgtttcttggcacgttttattcggcgaccgccgccattcagcaggcgcgcaaatattatcccggctctttaggctgtgaggaatgttgcccggtgaccgcggctagacctcagcctgcccaggacagtgtggcgcttaagcacggcgtcgatttctgattacgcgcgcccgtttgacgtaacgatggcggttcctggccgccatcctcaaccactccggtgttgccctttatatcgcccctctctgctgcctgacgcggccaatcatcctttcgttatcccagccagaagtggtcaattcgctaagctttttcgcttttttccgttatcttagagcccttactttctgacagggatttaccatgcgtgataaatttgccgcatctcaaattgcgcttcactggcttaccgttttgctgcttatcgtcgcctatgccaccatggaactgcgcggctatgtcgaacgtggctcctggcagcgctttgccatgatggtgacgcacttcagcgccggggcgaccattctggtggtgatgttgtcgcggttgctgctgaaaatccgtcatcgcagtcctgcaattattcccccggtgccgcgctggcaaaccggcctggcccacctgacgcacacactgatttatgcgcttttcattacccttccggtgctgggtctggcgtcgcgttatctgaaaggacgtgagtggtggttatttggcattccgatgccgatggccggcgaacctgactttgatctggcggacacactgaccgactggcacgagacgctcgctcccttaggctactggctgattggcttgcatgtggcagcggcgctgtttcatcactatgccctgaaagataatacgttgcggcgcatgatgcccggacaacgtaatcgccagccataaacaccacctgcaggcgccaggctaaaaaatttcatcttaatcggcgcctggtggttccacccggcgcttaattcctccacaataaccgctaaattgtgacgcaggtcactctcatggggtgagcattctcatccatttttgacgcacagactgatttaacttctcatgccatcaacaactgtttcccgtaaaacggcctggctacgcgtggtgctgctggccatcgccgcttttgtttttaatactaccgagttcgtaccggtgggattgctttcagatattgctgcaggcttttcgatgaaaacatcggaagtgggcattatgctgacgatctatgcctgggtggtggccttgttgtcactgcctttgatgctgttgacgcgaaattttgagcgccggttactgttaacggtgctgtttagcgtttttattgccagccatgtgctctcgacgtttgcatggagctttagctccctgatcgtgtcacgcattggcattgcgctatcccacgccgtgttctggtccattacggcttcgctggccattcgcgttgcgcctgcaggtaaaaagacccaggcgctgagcatgctggcgaccgggactgcgctggcgatggtgctgggcgtgcctatcggccgcattgtgggccaggcattgggctggcgtaccacattcggcgtgatcggactgtctggattggtgctgatgattatgctggtccgcatattgccccgactgcccagcgagcacacgggatcgctcagcagcgttcccctgctgttccgccgtccggcgctggtgggaatgtatctgctggtgacgttggtggtgaccgcgcactacaccgcttacagctacattgagccctttatgcagctcgtcgccaacgccagcgaggggttcacgacgttactgctgctgctgtttggttcggcgggcattgtcggcagcctgttgttcagctcgctgggtaaaaaattcccctctgccctgctgattgccgctatcgccctggtgaccctgtgcatggggctgttaatcttcgcggctgtccgccctggggctatcattaccctgtgcgtgatttggggaatggccatgatgatgatcggcctggggatgcaaatccgcgtgctgtctctggcccctgatgccacggatgtggcgatgtcattaatgtccggtatttataatatcggcatcggcgcgggtgcgctgttaggcagtcaggtcagcgcttatatgagtctgtctgatgtgggtaatgtgggggcgatgattggtctggccgcactattatggtgtgtctatattttcaaacgttatccgcagttacgttctaatggctgataataacaggcttcagattttatctggagcctgatgttatttactgctccccgtaacgctcatctcaaataagatcacagaccgtgcgacgtaaaactccggtgcccttccaggccctgctaaatagccgcttatcagggtgaatcattctgacgtcccgcgaaatagcgctgcgttccacctcatcgaaaacggtcaggttgctgaacagtcatgcaccgtccagcctgacgtaccggacatcggtctggctgaagtaacgcgtctggcggaagtaagtccccggccctgtttacccgcccatcgacgataaaatgccccctgaaaatacctgcaatccttaagcttatattcttagccttttttatggtcgttacgcccagcggtgcaggatcaacaggtttaaacgtgttgtattaaatgcttaattaaaatgcatcgctcatttatcaaggaacgtatcgcgcattgatttaggccaatagaatttaacccgcgggttataaagcccgtcggttactacgcagaacttaatatcacctcaataatctcaacacttccattacatctgtttaccccgtataacagagaaaataattaacgtcaggtgtcatgatgacgagaaaatggttaacgctctatttatcgcgcaacgtcagccaggtgatgctggaagactttcgggcaattttacccgcggatgggttgaaaatttttgttaatgacttagacgacacacaccatgccacagtagaatgtgttcaggcagaggattcatgcgcactcatcgcctctgccgttgtcgtgtggcgtcaactgggccatattcacacgatgatgtacaccaaaggcgagctgcagcgttcggttaatgaagcgacccagtttgagctgtttacgttgctgaagaaccatcgcgccgtgctacggctggcgtagccccggaataacatggtccctgaatattcatccctaactaccctgacaggataaacatgagaattggtctgttgttccccatcgctatcatcgtggccggtatcggttttctcgcctggtttattggcagtggcctggccatgccgggctcctgagcttaacgtagctgactgtctttactgccgcgacggttatacagactgctgtctttttgttgcttatcaattttttcctgacaggcgacacagtagcgcacgcctttcagtgcctgacgacgggcagccggaatcggctcaccgcaaagttcacactctgtggcgctctctccctggccaagcgactgacgtacgcgttcaataccgtcgttgaccgtactgtcgatctgttcctgtaccgccccttctgaagcccaaccgtttgccattgccatttccttacttcgtatcaaacacctcttaaatgtacaacatatctgatattttgcaggcaaaacggcgcacatccctgtgagcctgcacagcatgggttactgtttaatatcgacctgataaaagatgtgtttgccaaaaggatcgacttcatagccgctgaccgtattgcggactggctcgtaaatggtcgagtgcgcaatcatgacggcaggcatttgatcatgcatcatctgctgtgcctgcaggtacatgctggtccttttactttgatccggttcggcccgcgcctgggtgatcagcgtttcaaacggctgatagcaccattttgaagagtttgaaccgcctttcgccgaggtacagctgtagagcggcccgaagaagttatcaggatcgcccgtcgcagtggtccagcccatcagcgcggcctgatgttcgccgctgcgcacgcgtttaaggtattcgccccattcataactgacgatattggctttaatgccaactttggcccagtcagcctgaatcatctccgccatcctgcgcgcgttgggattgtaagggcgctgaaccggcattgcccacagcgcgatttccgtacccggcttcacgccagcctctgccagcagtgcttttgccttttctggatcgtagtcataatccttaagatccttgtccgcgctccatacacccggcggaaggatgtttttggcaaccgtacctgtgcctttaaaaatcgcctcaataatggccggcttgtttatcgccatagccagcgcctggcggactttcacattatctgtcggcgctttggtggtattaaacgccaggaaccccgtgttcaatcctgccgcctgcttcagggtgatgtccttgttctgccgcattttttcgagatcggccggattagggaacggcatcacctgacactcatttttttccagcttggcataacggaccgccgcatcaggtgtgatgctgaaaatcagccgatcaagtttggcttttccctgccagtagtcaggaaacgccttgtacagaatgcgtgagtctttttgatactgaaccaactggaaaggcccggtaccgatcgggtccatatcgaccttctcaggcgtgcccgccttcagcattttgtcagcatattcagcagagtggatggaggcaaaataccaggccagatcggcaagaaaaggggcttcaggatgagccagcgtaaaacgcacggtatggtcatctacgcgatcgatgtgggtgatgagcgtcgccaactccaggctgtcaaagttggaatagttgccacccgataccgcatgatagggatttttactgtccatctggcgcataaaagagaagatcacatcatccgcgttaaacgcgcggctgggcgtaaacagcttattactctggaatttgacgttatgacgcagatggaaggtataaaccttaccgtcgggactgatgtcccaccgctctgccaggctcggaatcagttccgttgtgccaggcttaaaatctaccaggcggttgaataccggcactgcgctggcatccacgctggttcccgaggtgtaaagttgcggattaaagttctccggggagccttctgagcagtacaccaacgttttcgcattgacgccgctcgccagagcaatacccgcagtaagcagtgccagggtcgttagcctgtttctcattattgtcctcgctttctgttgacttccgttagtcagaatatctaaatgaattatttagatgtttgatagatagcatgaatctccaccatagcgaaccccgcagtacgtcaactaataaggattagtgatgaccgacaaacttcagacgcaactgatcacgcgtttttttcgttacctggcggtaagcagtcaaagtgatgccaggtcgagcacattgccgagtaccccgagccagcacgcgatggcgaagctcctggcggacgaattgcgcgagctgggccttgagcaggttgtgattgatgaacatgccactgtgaccgcggtaaaaccgggcaactgccccggcgcgcctcgcattgggtttattacgcacattgatacggttgacgtcgggctgtcccctgacatccatccacagatcctgacctggcaaggagaggatctctgcctgaacccgcaacaggacatctggctgcgtcgggatgcgcatccggagatcgcgccctacaccggtcagccgatcattttcagcgacggcaccagcgtattaggggcggataataaagcggcggtgagcgtcgtcatgacgctgatggagaatttacagggcaaacatggcgatgtggtggtggcgttcgtccccgacgaggagattggcctgcgcggggctaaagcgctggatcttgaagcccgctttaatgtggattttgcctggacgattgactgctgtgaactgggcgaggtggtgtatgagaacttcaacgcggccgcagcggaaatccgctttaccggcgtaccggcgcatccgatgtcggggaaaggcgtgctggttaaccccttgctgatggcccacgattttatcagccacttcgacagacaggcgacgccggaacatacagagggccgtgaaggctatatctggtttaacgaaatgcaggccaacgccagtgttgcaacgcttaacgcatcgattcgtgatttcgatctgacaagtttcgcggcacgaaaacagcagcttcaacaggttgtcgagcttatcgccgcacgctatcccacgggcaaggtagagatgaccgttcgcgatatttacagcaacattagtaacgctattggtgacgatcgtcgggccgttgatctgatttttgctgccctgcgcgaactggatattgcgcccaaagtgatccctatgcgtggcggtaccgatggtgcagcgctttctgccaaaggattattaacaccgaacttctttacgggcgcgcataactttcattcacgcttcgagtttctgcccgtcacctcgtttgtgaagtcctatcaggtggcagagaagctgtgctatctggcagcggaatagttcatcaggaaggccgttgtaaaacaccgccttcgctatgaaggcggtgcacaggtttcgcttagaaggttacccagtcgccgttatccgcggtggcggttttcggctgaagaggtgccgatgggctggccggtgttgatggcggttttcggctggtcacgagtgccgctggcgcatcactggacaaacggaactgcgccaccgaagcctgcagggcttccgtttgcagggccagcgcactggcagcggcagacacttcttcgaccagcgcggcgttttgctgcgtcacgctgtccatttcggtcaccgccgtgccgacctgcgaaatgcctttgctttgttcttctgaggcctcggcgatttgcttcatgatcgcatcaacatcctgaaccgacttcaggataccgctcatggtgccgccggtggtgctgaccaattgggcgcccttttccacgcgctcaaccgaatcggcaatcaggctggcgatctctttcgctgcaccggcgctgcgttgcgccaggtttctgacttcactggctactaccgcaaagccacggccctgttcgccagcgcgggcagcttccactgcggcgttgagcgccagaatattggtctggaaagcaatgctgttgatgacgttggtgatctcagcaattttcttcgaactgtcagagatgccgttcatggtggtcaccacttcacccaccaggctgccgccctgtttcgccgttaccgttgccgcttcggtcagcgtgctggcctggcgcgcattttccgcattaaatttcacggtcgccgtcagttgttccatactggcagcggtttgctccagcgcggcggcctgctcttcggtgcgggatgacagatcgttattaccaatcgaaatctcggcggcaccgcgtgaaatattttccgtaccgctgcgaatagcactgacggcttcgcgcagactgtcctgcatggcgctcaacagcggcaccagtttaccgacgcagttacggcccatatcctcgacgggtttgctcaggtcgcctttggcaatcactgaaaaatgttcgcggattttttccagcggcttgaccagcatgttgaccagataacggtcggtaaacagcagaatcagcaagccaatcaccaccgtgactgaaatcattgttttcgtcatcgcggtcagacgatcgacttcgacgcgcgtttgccccagttttacgctggccactttattgaagttttcagtactggcaccgaaggcacggctcagggcgggcgtgacgtcattcgcctgttggcgatagacatccagcgaatcctgacgggcacgctgaagctgaacagtaacgccctggtcgagcaatttttgccatttatcaatcacgtcattggcaacggcagggtccatcgggccaggagaaagctgtttaaacagggttaactgctgagacatgctgtctaatgcctgttgtacgggcgcaaaagcctcatcgttttgcgccacaccggccgtttttttctccattacgcgcgacaaacgcgtgatcatacgaaaatactgatcgttacctttactcaacgcggtcatctgctcaacgatatggcggtcgacatcattgccgtcacttaatgacgtaagtgaatgaatgctgaacagaccgataccgctccacagcaggcaaaacagcccgagtatcgtcagcattaccgcgcgaatagtgaaatttttaagcatacccatactgaaatcccttaaacgttaacccgtaaaaccgggcgtatgggatatatcggcagaaaagccgaaaatgtaacggtgctgttatacttttttacgcggtcacggctgcatggcaataaatcatagcctgcagtgaaaatcaggcccggcggtgggcgcaagtgcatccggtactgacgaatctggccctacagccgcaccattcgcgccatcatcaggcgaaacagagacaggcggcgacgcataaagccccgcagcagcctgaatgacgccttaccctcgccaccaagtgacattgtcacgtcactgtctgcacgccagatgggccatgagcgttctccttcaagctgcgtcgtcttactgttaacgtcgcgggcgaagcggaaccagtagtcgctaacctgctgcgcaaaggcgcggtctgcagccgtgaagcagcggtcttcactgattacgggcatgttctcaagggtattcatcacgtagggaatttcattaccgtgccaggtgccgtgcggatagagatcccgggcattttcagagacgtaatcaaaccagtaacgccagcccggcatagcgactttttgctgtgcccgcatcaccagccagggaagaagcgtaaaggtcatatcgcgtgctgcggcacgcccgagcagcgcatcctgctcaacacggtaaatccacttcagcacacgatagctcaaccggttttggcggcgaatccgatctaccacggtggcggcatcgacgccgaaatactccagcacactggcctcgtcgctgttgctccctgccatcagcggcaggggatgctggcgtccggccataaaggtctccagcacaggggcaggcagaaccgcatcgcccgcgatagcaaccgggccgagcccatagcggctgtccagtgcccaaaaggcatcggcaggcagcgcgcggagctgttccatgctggcatcagcgggcaaacccaaaccggtggcgaccttcacccctttcttaagcgccgcagcgcggggaacgtcaggcaggctgtaggcactttgcactatccctttgtggaaaagaccggccgccagcggtgagcagcagagtgataacacgctacgtgcgcccgaggattcaccgaatagcgtaacgttactggcatcgccgccaaaggcgtgaatgtgctgctgtacccattttaatgccgcgatctgatccagcagggcaaaattatgaagtgtgccgctcgccgcctgctccttttccatcgccggatgcgcaaaaaagcccagatggcccagtcggtagttaatcgtgacgatcaccgccccgcgtgaggccagcggttggccattatagggggccagaccacccgaaccgatcgtgaaaccgccaccgtgcagccacaccatcaccggcaagggtttttctggtcgcagctctggcgtccagacattcaggtaaagacagtcctcgctgaaatcaccgggatcgcccccgcccatggcaagacaatagtcgcggttctgccagctcgcggcagaaaagtgcagcgcgcgtcgtacgccctgccagggtagcaccggctggggcgcacgccagcgttgttcccccactggcggtgcagcgtagggaatgcctttaaacacgaagatgccctcatcaatgccgccctgcagctctccgtcagcgagggtgatcttcaggcccttttcatttttcatgcgttgttccttgtctgcgtccgctgtcattatttcaggcaatttgccgttgtccagaaaggggaacggtaaatacgcctaaaacgcaccggttacgcacgccgtcgttgaccgctacccgcgaacgtgtgtttagtacagcgtatcgtttaacccgttagaggaagggaaaatgttcagtggtatcaatcaactttttgttcgaatgaccgatcatcctgattttggcaagctgttgttacgtttgacgctgggtggattactgctgtttcacggtgagttcaagctggtacacggcgtgggctggattgctcacctgctgcgacagcacggcctgccgggctttcttgcctggggcgcatggctgggtgaaatagttgctccgctcatgctgattgtgggattcatgacgcggcctgcggcgtttattattgcggtaaatatggtggtggcgacgctgctggtaaaaaccggggcggtctggcaccgcacggacgtgggtgcctgggcgctggaaaccgaagcgctattcctgctgggagcctttatcattatgttgctggggccggggaaatatacgctagtacgcgattcccggttgcagtagctgagtaaatcggggcgatagccgccccgatgttgttatgcctgtatgccacaccgctgtagtgaggcttgttgtcgtgcggcgtacagcgccatttcgtccagtacggcacagcccagtgcggtttcaaagctgctgcggcttgcctgacccgcagaacgcgcctgcgttttatcaccaaggttagactgaaaaatacctgccgcactcaccggcagaaaatcctcataaataatgggatcggccagcacccggccctggtcgatcaggctatccagtgattcaccatgccgaggcggttccgcctgccccttgtcactgaggcgataatgaaaccaggcgagtcccgcctggcgcagttgcgtttcgttatccgggaaagcctgaaatacggcggtcaactgctgctgatgctgttgattgtcagccccgctaccggcctcattcagcagccgatcgtaaagcgcgcgcccttgcggcgttaaggcggcaccgcgctgttcaatctcaccaaaacgtgcagtgtgggtgccctgatagccatctttgaaaaccacaggttcttccagcgctttaaaactggtctgacgcagtaaaatggggacgctgcgccgtggtgggccttcaataaccgctttgggatcgataccgcgtgccggcattaacgcctggacgcggtcaatgtccagcgtgcgtggcgtaagatggttgatatgacaggcagggaaacacaccacgtcggcaatcaaccggtgttgctgattgagcgcctgataggttttactctcaacgaggctgtgtgagtgccagcgaaaggtttctaacgcctcgtcgataaactgctgcgcctgcgcctcggtcagtccgccctgctgctgatgctgtttaatcaacgcgcggcagcctgcggtgaaaatatcccgcgaagccaggatagttgtggcttcgtcgcgcagcgcctgatcctcgatgagttccagtcgcagtaatgaggtgaagatacggaagggattgcgccgcagtgcctcgtcatcaatgggacgaaaagcggttgaatgaaccggcacgcccgcctgagaaaggtcgtaatagcctaccgggaacatgcccatcacagcgaacatctggcgcaacatggccagctcttcagcactgccgacgcgaatcgcgccgtgacgttccaggtttaaacggctcatctcatcagcctgggttaagcgttgctgcaatgcactatctgccgccagcgtatcctgattaacctctttgactaactgcatcagcgtgccgtagagcggcacctcttgctgatacatgtccgacattgcccttgaaaagccggtacggatggcatccgcacttaaaaagttatccataataaccacctgacagcgtgagcgttgcagctactgtaatccaacgcgttgtcgccagcggaaaatatcatgaatttgtgatcggcttaaaaccataacggtttttaatcaccagcattatcgtcgtgagcacggccggaatcgccagcagtaaaaagatcaggttgaaagaccagcccagcgtcagcatttcggcccccacaaacgcgctcaggatggcaccgagtcgtccaacaccgtgcatccagctggagccggtcgcgcgggcatgagtgggataatagctggctgataaggcattcatgccggtgttggccccgttaaaacagaagccgctaaaaaaggcaatgctactcattatggtgacctgtgccggtgagaaccctaacgccacaatggcaatgccaccgcaaaagtagatgacggccaacgccaggttggcattgaaccggtccatcaaccatccggcaaataaggaacccagcgtgccgcccgcttgatacatcgcagtaataatcgcggcctgggtaacggtcatcccctgcttgctcaccaaagaaggcagccagctgcctatcaaatagaccagaaacagccccataaaatagccgccccacagcatcaggctgccggtgcgataacgaggggaaatcaccgtcgcgatggcattcttttcaggctgcgcagcgtccgcttcagaggcgtgaaactgactatgcgagtgggtgctgccggggataatacgttccagaatggttcggatgcgttctgctggcgcaccccggctaatgaggaaacgcacggattcaggaagctgctttactaataccggcagcaccaacagcggcagaatgccgcctaataacaggacggaatgccagttgtagcgcggcaacagccaggacgcggcaaatccgccactggctgcaccaaaggtgaagccgcagaacaccacggtgataataaacgagcgtcggcgttcaggggcatattcggcaaccagcgtgctgacgttcggcatggctgcgcccagccccagcccggtcaaaaagcggaacagtaccatctgttcaatggaatgggaaaacgcggtggccagcgtccacaggccgaaaaaaagcacgctgaaaataatcattaagcgacggccaaagcggtcggccagcggcccggcaaccattgcgcccagcgccaggccgatgagtgccgcgctgatcaccacgcccaactgcgaattggtcacgttccaggccgttttcagcgagggggcgatgaagcccataatggcgatatccatgccatcgagggcgaccacgataaaacagaggacaatcaatcgaatttggccaccgctcaggctaccctgattgattaaccggcgaacatctaccgcctcaacgctgctcacgggcaccctctccttaacgaaataaaccatcagttttggtagaaaaaacggcgcttatgatagccgatcgttaatgataaaacgcagaattttgcatgcaaataataatcattcaacaagcggataattaagtcgatgattttacagcgactgcgcgcaggccatgacgaaaggaatcgtagcgcaggtatttattatcaataacttactgggattaccgtcaaaaagtacactttgttaataaatatttgcagcaaagttaacaaaatccggtttaaatagttgccagtcacctggcaatgtcattaagtttgggaaatggaaaaaaatatccttttcaatcagcgcattcgcttgcgtcatttacatgcctttgttgccgttgcgcagcagggaacgctggggcgtgcagccgagacgttgagtctcagccagcctgcactctctaaaacccttaacgaattagaggaactgacaggcgtcaggctgtttgaacgaggccgactgggcgcacagctcaccaccatgggggagcagtttctgacccatgcggtaaaagtgctggatgcactgaaccatgccggtcagagctttaacgaacagattaatgagcgtccggtgattatccgccttggcgcgctgaccacggccgccatgggcatgctgccacagattctcgatcgctttcatcagctgcgccccaataccaccattcaggtggccacgttacataacaatgtgttgctggccgggctgagagccggtgaatttgacattggtattggtcgtatggccgacaaagagatgatgaccggcttaacgtatgagcttctgtttctggagtcgttaaagctggtcgtcaggcccgaacatccccttttaagtgacaacgtcacgttgtcgcgcgcgatgcagtggccggtggtcatctctcccgaaggaactgcaccgcgccgtcttgcgcagcagatgctggatgaacaaggctgttgtttgccgccgcactgcgttgagacatcctcaacctcgctggcacgccagctggcgctgcgctatgactacatctggtttgtgccttcaggtgccattaaggaagatctcagccacaatgccctgttctcgctgccgattacctctcccgggcctggcgaaccggtcggtattatcacccgcactggcgatactttaagcctgagcgctgaagtccttatgagcaccattcgtaagtttcacagctagcgactgcgttttgcatgtcgctcccagttttcctggcgcgctttttccgtcttacgcaatccgacgtaaagcgcgcccgccccgccatgctgcttttgcgccacacaaaacgtctgtacctcatccagttcgcgcagccagcgatcaagataactgcgcacaatattggcgtgggattcgctgtcgcgccctttaccatgaatgattagcaggttgcgaaaccctgcttgtcgcacgtcccgaataaacgtaaacaggttctgtcgacaagcttccacgggttgacgcagtaaattaaggctggcgtccagcgcatactggcctttgcgtaatttatctagcacaccctgctgaataccttcagctttgtattccagcggctgatccagcgggataatgtccagatagccgcgggttaaaaaattttcatcttcctgttctggcggcggctggcgggttttcttgctggcggagagattattccacagcgtattatccgcatccttcagtggcgtaacgtcattcatcgcgtcacggaacagattgtcatcgtcaaggttcatggctcgcccctgttaaatgatatgacgcaaaattgtatataacccgaatagtagcaaaatcgggaaagtctgcgctaatcccgtttttagcgttttcgccaggcatgacagtgaagatggattctgttttagatcaaaaaagcgtaaacatttatttacggaggttacactttgacatcaaaaaagcccgtcagaacagcctttagccgccgttaacaaaccacactttctgtaggcctaaaaactgctcggatgagttcctttacgaccaaaaaatggtaaaattgaccacagtcaattatcgtcgagcaaaccattatgttccctgaaaaacgtatacagtcaggcggttgtgcgattcactgccaggattgcagcatcagccagttatgcatccctttcacacttaacgaacatgagctggaccagcttgataatattattgagcgaaagaaacccattcaaaaaggccatacgctgttcaaagcaggtgacgacctacgatcgctttatgctattcgttccggcaccattaaaagttataccattaccgaacagggcgatgagcaaattaccggcttccacctcgccggcgatctggtcggctttgatgccattatgaatgccagccatcccagctttgcccaggcgttggaaacggcgatggtctgtgaaatcccctttgatacgctggatgatttgtcgggcaaaatgcctgctctgcgtcagcagatgatgcgtttgatgagtggcgaaatcaaaggcgatcaggacatgatcctgttgctgtcgaagaaaaacgcagaggagcgcctggcggcctttatctggaatttatcccgccgttacggccagcgtggtttctcccagcgtgagttccgtctgaccatgacgcgtggcgatatcggcaactatctgggtttaaccgttgaaaccattagccgtttactgggccgctttcagaaatccggcatgctggccgtgaaaggcaaatatatcaccattgagaaccacgccatgctggaaggtctggcgggtcaaagtcaccaggccgcctgacagataagccgggttaataaatcttattttattgatccggctacatctttttcactttcttagtgcacttaacataggctatctttaatccagtcgctttggtttaaggagagtagcctatgtcccagtatcaaaatattctggtcgccatcgatccgcaacaggatgaccagcccgcgctgcgacgtgcggtatatctcaaccagcttatcggcggcaaaatcaaagcttttctgcctatctacgacttctcatatgaaatgaccaccctgctctcaccggatgagcgtacctccatgcgtcagggcgtgattagccagcgctcagagtggatacgtgaacaggccaaagcctatctggatgctggcgtggatatcgatatcaaagtgatctggcacaatcgcccttatgaggccattatccaggaagtgttggcgcaccagcatgatttagtgcttaagatggcacatcaacacgatcggctggaggcggtaatttttacccccacggactggcatttgttacgcaagtgcccttgccctgtgtggatggttaaagatcagccctggcccgaaggcggcaaagcactggtggcggttaaccttgccagtgaagaacctcaccatgatgcactgaatcagaaattaatccgcgaaaccgtcaaactggcagaaagcgttaaccataccgaagttcacctggtcggcgcctatcccattacgcctatcaatatcgccattgagctgcccgactttgatcccagcgtgtacaacgacgccatccgcggtcaacacctggtggcgatgaaagccttgcggcagaaattctccatcagtgaagaatttacgcatgttgaaaaaggcttaccggaagaagtgatccccgaattatcgttacatctggacgcgggaattgttgtcctgggcactatcggccgtaccgggttgtctgcggcgtttctgggtaacacggctgaacaggtcatcgatcatctgcgctgtgacctgctggcgataaaaccggatgattttgtttcaccgattacgctggatgacgaagacgagaacgactgatccttcttactgcaaaaagggcgaccctgtgagtcgcccttttttattacagcgctttcaggatattttccacgctggctttggcatcaccaaacagcatatgggtgttttctttaaagaacaggggattctggacgccggcgtaaccggtattcatcgagcgcttaaacacaatcacattctgcgccttccagacttcaagcaccggcataccggcaatcgggctaccgggatcgtcctgagcggcgggattgactgtgtcgttggccccgatgaccagcaccgtatccgtgtcgctgaaatcatcattgatttcgtccatctccagtaccacgtcataaggcacttttgcctctgccagcagcacattcatatgaccgggtaaacgcccggcgaccggatgaataccaaatcgtacttttatgccacgggcacgcagcttttccgtgatctccgccaccggatattgcgcctgcgccaccgccatgccgtagccgggcgtaataatgacgctactggatgctttaagcatttcagccgtgtcttccgcgctgatttcacggtgctctccagcctcttcactgtccgctaccgcgctgctgtcgctgccgaagccgcctgcaatcacgctaataaacgaccggttcatggccttacacataatgtaagagagaatcgcccccgacgaccccaccagcgcgcctgtcacgatcaacagatcgttgctgagcataaaaccagccgccgccgccgcccacccggaataggagttcagcatggacaccaccaccggcatatctgccccgccgatggaagcgaccagatgccagccaaacgccagtgcgatcaccatcatgacaaacagggcaaatccctgcgcgccgggactgtcagtgttaacgaaccagaccaacagcaggaacgacaccaccaacgccagcagattcagcttgtggcggtgtggcagcatcagcggccgcgacgacagtttgccacacagcttaccgaaggcgaccaggaaaccggtaaaggtgaccgcgccaataaaaatgccgataaacacttcactgaggtggatgttttccatcaccgcaggcagaccgggcgcatgatcgatatagctgttaatccccaccagtaccgcggccaggccgacgaaactgtgcagtattgcgaccagttcgggcatttcagtcatttcaacccgttttgccagccggatgccgatggcgccgccgatgatcattgccagcaaaatccagacgacattgctgctgtccgggccgaagatggaggcgaacaaggcaattgccatgccgctgatgccaaagatattcccttgtcttgagctttcatgttttgaaagacccgcaaggctcataataaaaagtattgcggcaacaatgtatgctgcagtcactaatccgccagacatcggttaccccttacgaaacattttcagcatacgctgcgtgacggtgaagccaccgaagatattgatactggcgatcaatacggcaataaaagaaaggaaactgacccagccgccatgacccatttgcaatacggcccccaccacgataatgccggaaatggcattggtgactgacatcaacggtgtatgcaacgcatggctcacgttccacaccacgtagtaacccaccacgcaggcgagcgcgaacaccgtaaaatgcgagagaaattcactgggtgccacattggccaggcagccaaacagcacgataaacacggccagcagcagatacttacgccgtggtgatgcggccgcaggctcgctctttttctgcacaggtgcagcggtggtggtggctttcggagcggctgacacctgaattggtggtgcaggccaggtgacatcgccttcacgcacgaccgttacgcaacgaataactacgtcatcgaaatcaatatcgatctcaccgtttttctctttacacagcagcttcatcaaattgacgaggttggtgccgtaaagctgtgaggactgggtcggcaaacggctgggtaaatcggtgtagccaataattttcacgccgttctctgtgaccgtcacccgatcggcaacggtgagtgcgcagttgccgccggtttgcgccgcaaggtcaacaataacgctgcccggcttcatgctggcaaccatctcttcggtaatcagcgttggcgccggcttacctggaatcagcgccgtagtgacgatgatatccacctcttgagcctgctgagcaaacagcgccatttcagctttgataaaggcatcggacattactttggcgtagccatcgccgctgccggcctcctctgcaaaatccagttcgagaaattccgcccccatactctggacctgctctttgacttcagggcgcgtatcaaaggcgcgcacgatggcaccaaggctgcctgccgcaccaatcgccgccaggccggcaacgcctgcaccaatcaccatgactttagccggtgggactttccccgccgccgtgatttgcccggtaaagaagcggccaaactcatgagcggcctcgacgatggcgcgataaccggcaatatttgccatggaactgagcgcgtcgagcgactgggcgcgagaaatacgcggcaccgcatccatggccatgacggtgacatgacgcgcagccagcttttcaagcagctcaggatgttgggcgggccagataaagcttaccagggtactgccctcgcgggtgagcgcgatctcttcgtcatccggtgcattgacctttagcacgatatcggcctgccagacctgctggctgtcactcaccgcagcgccagcggccctgtagctgtcatcatcaaagctggcgcgcttgcctgcatcatgttcaatggtcacgctgaaacccagcttgatgagctgttcaacggtcttgggcgtggctgccacgcgcgactcgttagccaatcgctctttgggtattccaattaacatagttttccctttcatcgattaaaggaggatgatccttgtggtacacaatgccgtgacgacacccgctttcaggcgttgtgaatgaaatgcaataacctaatcgtatctaaacctactgaaattgttacggacgatctactacacagacccacatctgtcacatttgccgtaatatccagttgaagcacggcaattccgcctgtccgcactgcacgaagactctcgcagcagataatctgctaaatatcacctgttccgccctgatattccttttggaaaaagccaaaattaacaatgtattaaccactttatcgatacatttactggtcaattcatcttattgtcgtaagcgtaaggcaaaatagcgtcgcgtgacgctgtgattaaataatctggttcacaacaagagagatatcgcaaaaaatggctgcgacagcgtgtttataacatgtaataatcagcggctaatctgttatacatcaagagtccagcacgttttcgtactcattttgcgtaaggcgaaggatcatttttatgaagctgaagaacactattctggcatctaccctgttatctctgctggcagcaaatgcgtttgcggctaaagagctgacgccagaacaagcggccgcgttgaagccattcgaacgtattaatatcaccggtcgttttaatgcaattggcgatgcggctgatgctgtatcaaagcgtgctgatgaaatgaatgcagattcctattacattcaaggcattaacgacagcaacggtaacagcggtaactggcgtgtgaccgccgatctgtacaaggctaatgcccctaaagccagccaggaaaccgactatcggatgttcaatggcctgaaagagctgccgaaggcggaagcttatcgtctggagcctttcgataccgttaccgtcagcggctttttcccaagccagcctgaggtaaatgaagccatttccaaagccgcgaaagaaaaaggcgcagcctccttctttattgtgcgtcaggttgatgccaatactggcggcaatcagtttgtgacggcctacatctataaggccgatgccaaacaacgtgtggtacagagcccggacaccatcccggccgactctcaggcaggtaaagcggctctggccgcaggcggagccgaagcgaagaaagttgaaattccgggcgtggcttcatccgaaaccccaagcaacgccgtgggccgtttctttgagacccaaagctcaaccggtaagcgttattcggtgactttgccggacggcaaggaaattcaggaagtgaatgcggtgaccgcggcgcagatgcagccgtttgataccgtgaccttcagtgggcatttcggttccccgactgaagtctcacaggaaaccgccaagcgcgcaggcgcgaaaggggctaaattttaccatgtgacgcgtcagtggcagaaccagagcggtggtaacctgaccgtaacggctgacctgtttaagtagcacgcgccagggcggcgatcgccgccctgctgtctgtttgcataattcctgctcgattttgcataaccacgcattgccatcccgcaccgcactccgtaaaatcctccgcctgtttttcagagtattaaacgcgttatacgtaacacaatcacgatataacgttgtgtttatgctggttatccagccacttatactagcaggaagaacgttttggagaaaaaattaggcctcagtgccctgacagcgctggtactcagctcaatgctgggagccggtgttttcagcctgccgcaaaacatggcggcagttgcaggtccggcggccctgttaatcggctggctgatcaccggcgcgggcattattttcctgtcgctggccatgctgttactgacacggctgaagcccgaactggacggtggcatttttacctatgcccgcgccggatttggcgaactcactggtttttgttccgcctggggttattggctgtgcgcggttatcgctaacgtttcgtatttagtcattgttttttctgcgctgagtttcttcaccgacacgcctgacagaatcctctttggcaatggtaatacctggcaggccatgctgggcgcatcggtattgctgtggctggtgcactggctggtgctgcgcggcgtgcaaaccgcagccagcattaatctgctggcgaccctgggcaaactggtcccgttgctgctgtttattgtgctggccgtgatcgcctttaattatgaccgcttccggtttgatttttccgggctcagtctgggcgtacagttgtgggaacaggttaaacagacaatgctgattaccctgtgggtatttatcggcgttgaaggtgcggtggttgtgtcatcacgcgcccgtcataaaaaagatgtcggacgcgccacgctgctggccgtgctggctgccctgctggtctatttactggttaccctgctgtcactgggtgtggttccccgcgctgagctggcggaaatgcgcaatccctccatggcaggcttaatgacgcggctgacggggagctggggcaacgccattatcgtggtgggcctgattatttctgtttgtggtgcctatctgagctggaccattatggcggctgaagtgcccctgatcgcggcacagcaaggtgcgtttccacgcagcattgcccgccagaacgcacgtaacgcgcctgccgcctcattgtggctgaccaacggcagcattcaggtttgcctgatccttatcgccctgaccggtgcggattacaacaccctgttaaccattgcgtctgaaatgattctggtgccctatttgctggtcggcctgtatttgattaaggtcgttaaaggacagcaaaagccctgggcactggccgtgggtgtcggtgccagcctgtatggtatctggctgttgtatgcatcaggcccactgcatctgtttatgtcggtggtgctgtatgctccaggtattttactgtttatttttgcgcgacgtggcggacatgaggtggcgttgaagccggtagaacgggttgccatgatgctaatcgtagcggcaacccttcctgcgatgtgggaattgctggcttagtgagactgccccagaaccacacacagcaggtcatcctgctgtgtcagcgcaacaggcttgcggtattcttcatgaatcgcctccagctgtttatccgacaacggatacggcagttggatatcgaagcggcaaatctgttgctgctcagcgagcgtgatcagacgggcgatgttaatttcatcgctgacctgggttgaaatgatttgtaatgctaattctttaagctgatcttcactcgcctgcaagctgtgcgcagatttgcgtgtcaccatgccgaatataggcagtacgccgtagatcgcatccacaaagctccatcgttttttacaggatgccgacaggaaatcactgtaattaaagcagatgcgatcgcggtataccgctgatgccagctctttatcaaacactttggctcctcaaggtgatcacaatgaatccggaactcacgttaaacgcagggttaatgattgcatattttgcggaatatatcctagttactcaaggatatttcgtgtgattgcatagagctctgcgccaggaaaagttatgctttactcctcctttttacgttagaaagaatcatgcacaaaatcgtttacgtagaagatgaacccgaagtcggttcgttgattgccgcttatcttggacggcatgatattgaagtgattgtggagacgcgcggcgatcgggcggaagcgaccattgccgaacagcaacccgacctggtcatgctggatattatgctgcccggtaaggatggcatgtccatctgtcgtgatttgcgcgcagaatggcaggggccgattgtgctgctgacctctctcgacagcgacatgaaccatattctggcgctggagatgggcgcgcaggattatatcctcaaaacggctcccccagcggtgttgctggctcggctgcggctgcatctgcggcagtcccaacagggacagagtgaagaagcccctgcgccggcgaaaaacaaccgcatgttgcgctttggttcactgacgattgatgcgctcaatcgccaggtcgtgctgtttgatgaaaacattgccctctctacggcggatttcgatttgctttgggtactggcaagtcatgccgggcaaattctgaatcgtgacgccctgctgaaaaccctgcgcggcgtcagctatgacgggatggatcgcagtattgacgtggcgatttcgcgcctgcgtaaaaagctacacgacagcgccactgaaccctttcgtattaaaactatccgtaacaaaggctatctgtttgcgccgcaggcctgggacacgcgttcggtatgaaaaaactttttattcagttctacctgctgctgtttgtctgtttcctggtgatgtcgctgatggtcgggctggtatacaaatttaccgccgagcgcgccggtcgccagtcgatgaacgacttaatggccagttcgctctatctgattcgcagtgagctgcgtgaaatccccccgcgcgactggaacaagaccattaaaagtctggatctcggcttgtcgtttgagctgcatatcgagccaatgagtaaatttgaactggatgaaaacgaacttcgtcggctgcgcgcaggcgaaatcgtcgcactggatgataagtacaccttcctgcagcacattccgcgcagtcactacgttctgaccgtggggccaatcccttatctcttctacctgcatcagatgcgactgctggatatggcgctggtggtgtttatcggcatgtcgctggggctgccggtctttatctggctgcgcccgcactggaaagagatgctacgactggaacacgccgcccagcgtttcggccaggggcagttggatgtccgaacccactttgacagcacctccagcctgttcagggttggggtggcgtttaaccaaatggcagagaacatcaatacactggtcgccagtaaaaagcagctgattgacggtatcgcccacgaattacgtaccccgctggtgcgcctgcgttatcgcctggagatgagcgataacctgacggaagcggagtcggcggcattaaaccgcgacgtcagtcagttagagagcctgattgaagagctgctgacctatgctcgccttgaccggccgcgcgtcgatcttaatttgcaatcgctggatctggcgaactggttacgtgaacgcatggaagacttccgggcaatcaacccggagacgcaaattgacctggatttgccccagcgtgaaaactacggcatctcggacacccggctcatggagcgtgtgctggataatctggtgaataacgccctgcgctatgccagtcagcggttacgggtcagcctgtggtttgatggtgcccagggaaatctgcaggttgaggatgacggcccaggcattccccttgacgaacgtgaacgcgtattcgaaccttttgtacggctcgacccgagccgtgatcgcgcaaccggcggctgtggacttggccttgccatcgttcactctatcgcccacgcgctcagcggcagggtttccattgaaaccagcccgcttggcggggccagcgtccgtctctgctggccactggatcttccctttcgggaactcccacgacattaacgcattcaggagctttgtgtgacttcagcttatcaacaactttgtgccacttttcagcgcctgtcgcgcttcagtcacgtcagcgccatcgccggatgggatatgcaaaccatgatgcccgccggtggcagcgccgcacgtggcgaagcgctggcagagatgagtgttttgcaacaccagattctgacggacaaacgtctgggcgagtggctggaacaggccgagcagcaaccgctgaatgatgtagagcgcgccaacctgtttgagatgcgtcgcgcctggacgcaggccaccttgctgcccgctgaactggtcgaggcgaaatccatcgcgggttcccgttgcgagcatgcctggcgcagccagcgtccggcgaatgactggcagggttttgccccgaatttaaaagaggtggtgcgcttaagccgtgaagaagcgcagctacgcgcgcaggccaatggctgttcccgttatgatgccctgcttgacgtttttgagccggggatgaccagcgcccggctggatgaaacctttgggcagttaaaaacctggttgccccagctgttacaacaggtcgtagaaaaacaggcgcagcagccggtggtaaaacctcagggaccgttcgctattgatgcgcagcgcgagctggggcttagcattatggcggagctgggattcgattttaaccatggtcggctcgatatcagcgcacatccgttctgcggcggtgtaccggaagatgtgcgcattactacgcgttacaatcaggatgagttcctgagcgcgatgatgggtgtgattcatgaaacaggtcatgcccgttacgagcaaaacctgccaaaacagtggcgtggccagccggtcgcgctggcgcgatccacggcgatccacgagtcgcagagcctgtttatggaaatgcagctgggccgcagcagccagttcctgcagcgcatcctgccgcaggttatcagcaaaatgggtgaccagccggcactgcaggccgataacttcgtgcgcctgactcagcaggttaaacccggtttaatacgcgttgatgctgacgaactcagctaccccgcgcacgttattctgcgttatgaaatcgaacgtgctttgatcgaaggcgatattgaggttgaggatattcccgccctgtgggatgagaagatgcaacagtcccttggtattgatacgcgtggaaactatcgcaatggctgtatgcaggatattcactggactgacggtgcatttggctatttcccgacctacacgttaggcgcgatgtacgccgcacagctgtttcaggccttgcaaaaagccattccgcagtcggccgagctgattcaacatggcgagttacagcccatctttaactggctgcaacagaatatctggcaacacggtagccggttctctaccgagcagttgatgcttaacgccacgggcgaagcgcttaatccgcactatttccgcaaacatcttgagcagcgttacctgaacagttaaggtagcaggcgacctgagggtcgcctttctctgtccccttccccatgttgtacaatcggttacacggcgataccaatgacccacggacgcgctgcttattttctcatatagtcatttcaccggccccgcagtgggctacacatgaaaaaatagtccgagggttttgcaatgaaaaaattatttgcactggtaatcgccgctgctatgggtctgtcttcagttgctttcgctgccgagacaactgctgctccagcagctgctgcaaccactactactaccgctgcacctgctaaaactgaacacaaagctgctgctcacaagaagcatcacaaagctgcacagaaagcacaggctgctaagaagaaagccgttaagaaagacaccgcgcagaaagctcaggctgctaaaaagaaagtagctaagaaagataccgctcagaaagcgcaggctgctaaaaaacaccataaagctaaaccagctcagaaagcccaggctgctaaaaagcaccacaaagctaaaccagcccagaaagctcaggctgctaaaaaacaccacaaagctaaagcagcccagaaagctcaggccgctaaaaaacaccacaaagctaaaccagctcagaaagcccaggctgctaaaaaacaccacaaaaaagccgctaaaaaataaggctaccccttcgggttccgagtaagcgttaatcattaaaaacacccggttctgccgggtgtttctttactggagtggctaatatggtccgtcgctatcgcttcgaaattattctgattgtgatgatcttatgtggcgttatcgcggccagtttttttatttagtcgctgtagcgtactgattaactgaaaaaactcccttttttaccgctcactgactatagttatgtcacttcagctataacaaaaacgttttctttttctcgctattgagagttctatgcgcctggctaccctgttaatcgttggacttttcagtttcaccgcttgtgttcatgccgatgatgatgacgactcgccgacgcctgccgaaataaaaatgctgtttttcggtaaagatcaccgtcaggcaattaccgacgtcagttccgcgccctgggatgcgataggccaactggaaaccgaaagcggtaacctgtgcaccgccacgctgatctctccccatctggccctgacggcgggtcactgtttactgacgccaccgggcaagtttgataagccggttgcgctgcgttttatgtccaccaaaaaagggtggcgctacgaaattcatgatattgatgcccgcgttgaaccctctttggttaacaaactgaaggccgatggcgagggatggatcgtgcccagcagcgcggcgccgttcgactacggtctggttattctgcgtaatccgccttctgccatcacccctattcccctgtttgacggttcacgcagtgatttaacggaagcgctgaaaaacgctggacgtaaagtcacgcaggctggctatccggccgatcatctggacaccttgtattcacatagcgactgcctgataacaggttgggcgcaacgcgccgtattatcgcaccagtgtgataccttgcctggcgacagtggttcgcctttactgttgaaaggcgataaaggctggcagctcattgccgtacagagttcggcaccggcagcaaaagaccgctatcttgccgacaaccgggccattgccgtgacctcgtttaaagaccggcttgaagcgctggcccagtagcttgcctgagggtttacacgctctgaacgcataaaaaagcccgcatccatcaaggtgcgggctttttttcgctcatcacatcaggcatcaatggctaccctgcaatttgctccatcgcctgtaagatacgtttatccgagatcggataaggcgtgccaagctgctgagcaaactggctgatacgtaactcttctatcatccaacggatatgctgcacgtcttcatcatcctgacgctgtggcggcagtttgttacgccaggcctgccatgcttgctcaatggcctgcactttgagcatacgggcacgatcgctgtgaggatcgaccgccaccttctccagccgacgctcaatgccctgtaaataacgtaacgtatctgccagatgctgccagccgttctgggtgacaaacccccggtaaaccaggccattcatctgcgctttaatatccgccaatgccagtgccagcgtcatatcaacgcgtcctttaagacgcttattgatgttaaacaccgctgtcagaatctgctcaacctgcttcgcaatcgctaccacggtgtcattcagctcggcgcgcactttctcacgcagcgcttcaaactgcgtttgttcccatgccggaccaccggcctctgcgattaacttatccacgccgcaggcaatgcagtcatcgatcaactccatcaccttgccgtaagggttaaaatacagccccaacttggctttgttgggtaatttttcgtgcagatacttcaccggtgaagggatattcagtaacagtaaacgacgctgaccgcgccacatcattttctgctgctcatgctcactgtcaaacaaacggatgccgacgctgtccttctcgtccaccagggctggccaggctttaacctgatagttgccgcgtttttgctcgtaactccggggtaaatcgccgaagctccagagatgtaaaccgctctgctccaggccatcgtccgccacctgggacagcgtttcctgtaccttgccttttaacagcactttcagcgcggccagatctttaccttcctgcagtttgcggttgtgttcatcgacaacacgaaacgtcattttcagatgatcgggcacctgttcccattgccagttgtcccgttccagcgtcacgccggtcatccggcggaattcccgcgacagcgcatcgagcaatggcatctccattgcagtaacccggcctaagaaggcttcagcatagttaggagcaggcaccaggttgcgccgcagcggcttaggtaaggatttgatcagtgcgatgataagctcacgccgcacaccggggatctgccactcaaagccggcttcatccacctggttaagcagcggtaacggaatatggaccgtgacgccatcagcatccgcgcccggctcaaactggtaactcagtttaagtttgaggtttccctgatgccagacgttgggataatcaagctgactaaccttatctgcgccctctttaatcagcatctgcttgtcaaaattcagcagctcaggattggttttgctggcctgtttccaccagctatcaaaatggcgggctgaaacaacgtctttgccaatgcgctggtcgtagaacgcaaacagagtttcgtcatccaccaggatatcgcggcgacgggatttatgttccagatcctcgacttcactgcgcagtttctgattggcacggaagaatgcgtggcgcgtttgccagtcgccttcaaccaacgcgtggcgaataaacagctcgcggctgagcgttggatcgatggtgccgtagttcaccttgcgcgcggccacaatcggcaaaccgtacagggtaaccttttcgctggccataacggcgccctgcgatttctcccagtgaggttcactgtagctgcgtttaatcaggtgctgagccagcggctcaatccactcgggatcgatacgcgccgcgatgcggccccagaggcggctggtttcaaccagttctgccaccattgtccacttaggcggctttttaaacaaaccggaccctgggaagatggcaaagcgagcattgcgcgcgcccgtaaactcctgtttgtcggcatctttctgaccgatgtgtgacagcaatccggtcagcaaggcacagtgaatctctctgtactccgctggctcgctgttaacgggaatgcccagttcacgcacgacctggcgaagctgggtataaatatcctgccattcccgtacccgcagatagttcaaaaagtctgttttgcactggcgacggaatacgttaccggacagcgctttttgctgctcgccgaggtagttccacagattcacaaacccgacaaaatccgactctttatccgcaaagcgacggtgtttttcatccgaggcctgcttcttgtctgcgggacgttcgcgggggtcctgaatggataaaccagcgacgataatcatcacttcccggacgcagccatactgctgcgcggccagcaccatgcgtgccaggcgcgggtccacgggcaactgcgccagctggcggcccgatccggtaagcttatactgcccgtcgtcactgagggttaatgctcccagttcctccagcagccttacgccgtcctggatgtgacgtttatccggcgcttccacaaacgggaaagcggcgatatcacccagccccagcgccgtcatctgcaaaataacggacgccagattggtgcgcagaatttcaggatcggtaaatgccgggcggctgagaaaatcatcttcggcgtaaagccggatacagatcccttcggatacgcgcccgcaccgtcctttacgctggttagccgatgcctgagaaatcggctctatcggcaaacgctggacttttgtccggtagctgtagcggctaatacgcgcggtgccgggatcgataacgtatttaattcccggtacggtgagcgaggtttcggcgacattggtcgccagcacaatacgccgcccgctgtgcgactgaaacacccggttctgctcgctgttagaaagacgggcatacagcggcaacacttcggtatggggcagatcgcgcttcatcagcgcgtcggcggtatcacggatttcacgctccccgctcataaaaatcaggatgtcaccccggctttcacgcccaagctcatccaccgcatcgaagatagcctgaagctgatcgcggtcaacatcttcagcctcttctactaccgggcgataacgcacttctaccggataggtgcggcccgacacctcaatcaccggcgcgttattaaaatgccgcgagaagcgctgtggatcgatggtcgctgaggtgatgataactttgagatcgggacgacggggcaacagttcacgcaaatagcccagcaggaagtcgatattcaggctgcgttcatgggcttcatcaatgatgatggtgtcatattgcatcagcaaccggtcctgctggatctccgccagcaggatgccgtctgtcatgagtttaatctgggtggtttcgctgacctggtcgttaaaacgcaccttgtaacccacacagccaccgagcgacgtttccagctcgtcggcgatgcggttggcaacagtacgtgccgccagccgacgcggttgggtatgaccgattaaaccggtaataccgcgccccagcgtcaggcaaattttcggtaactgggtggtttttcccgagccggtttcacccgccacgatgaccacctgatggtcacgaatcgcgtcagcgatggcctgctgcttctggctgaccggcaggttttccggaaacgtaatacgcggcgtcgccgcaacacgatgtgtcacacgctgttctgcagcgatgatatcctgctctagctcggcagcaagactttgctgtgcctcaggatttttgatttttttagcgccgtgtagccgacgctgtaagcgttgacggtcgcgcagcattaacccatcaagccgcgaccagagcggcgttaatggcgatgaaaccggagaagacatagtgatgacgtaccctactcagacggggtggactcagcgcacggcgctaagataaccggctgattaacgataataattgcgcctagcatagcacattccctttcgcgtcgtggccgtcggcaaaaccagcttgttcaattaattcgaatatagctctcgaaatattgcgctttcaccctcggcctgatgtttgtagagtgtaaatcattgagcggaaagccttccgcataacagacaggaaactaccatgagcaaagtattagttctgaaatcaagcattcttgcgggttattctcagtcaagccagctggctgacttctacattgagcaggctcaggctaaaggcgaccagatcaccgttcgcgatctggcagcaaacccggttccggtactcgacggtgagttagtcggtgcgttacgcccttctgatgccccactgtcaccccgtcagcaggatgcactggcgctgtctgatgaactgattgcagaactgcaggcgcacgacgtcgtagtgattgcagccccgatgtacaacttcaacattcctacccagctgaaaaactatttcgatctgatcgcccgtgctggcgttacgttccgttataccgaagcgggccctgaaggcctggtgaaaggtaagcgtgctgtgattctgtccagccgtggcggtattcacaaagacaccgcatctgacctgctgaccccttacgttaagctgttcctgggctttatcggtatcaccgatgtcgagttcgtgtttgctgaaggcatcgcttacggccctgaagtcgccaccaaagcaaccagcgaagccaaagacgcgattaagcagatcgtcacggcgtaattatgctgttttgatccagaaccgggcacccgcccggtttttttatgcctgaaatgtctcgcccggccaggttatttctttagccattgaccgttaatgccgcgcacgtattcacccgcagccgcacgcgtgaccagcttttgtcccgcaattcgggccacgtcgtctgttttcaggttgttctgctcggcaagacgttggtactcggcgtttcgtccgtcattaatgcgtttaaccagcgccagcgtttcactgtcgtctgatcgcggcgcaatatagcccgacagggtttcgcccacccgacctgactgacgcgcctcatcaagcgttaaagcccaggcgggctggctcatcgtcgtcgccagtaaaagtgcaatactgatgcgtttcatgctggctctcctcagaacaggccgctctgatttttcagtaaggcttcgacatccttgtccactttaatgtggatctcatgctcaattttcacattcatattaatggtgatgggctctttcggtgcggtcacttcaatgcgcggcacgcaacccgttagcggtagccaggctaccatcagcagtacagccctgaggctcatggtaattgatcctttttcgacggcaaggtggcgttttgctccacccaggattgcaaattatcgccaaaacgcaggctgcgccacagctggaacaggttttcctgatgacgatagtttaaattcacggtctgagtacgattactgaaacggctggtgcctttcacttgcgactccatggttagctccccgagattatccagattaagggtggcccacgaacgcgaaatctccatatagcgcagccagtccatcgccgcgccagcggcgatattattccgggtaatggcatcggccatgtctttatccaggcggaaggttagtggcccgctgttggctatccagccgttttcaacgatccagcgaggattattgatccacagcggtaattcgccgttcacgcttcctgacatggcaaactgtttgggatcaatagcactgacaagcttgctcaggctgatgtttcgcagcgaaacgcgcgccgggctgtgctgcggcagccgtaatgacggcatcgtgatctggccgtccagcagatccatgctgacatcctgtaaccatagcggatcgctttcacgccaaggataagcaccttgtaaatcgacccgaatattctgcatggcaaactggtttttgacttcagcgatacgtaatgaaaccggcccgcgacgtccaaaatgccactgctgatgttgtagacggaaaggcagggaaaaatcgataccgttgacctggctgtcgggtgtccagacgctgccgtttttcacagtccagtgtccgccagcctgaaagccctgcttagccgcggcagaaaatgctacctgggcgcgcaactcacctgactgaatcttcattttcagttcaggactgagcagcggctggaacaccgtcagcgactgggttggccaccaggcctgtccacgtaaacgctcgccgtcccagcgaccgttaacacgcaccggtccgaccttgcccgctttcagctgtccgccccagacgaaatgacctggatcgcggcctgtcgccgcaaagtccagggtggaatctgccagccagccgccgtagttaaagcgcgtttcccctgcctgcatctggaacttaccgttaaatgatggatggcgctcatcacgctgccagttgaccggtgccgtcagcgttaagcggggcttttcaacccgaacgccaccgtattcaagttggttaaaccctgtagacaagcgatcaagatgaatcagcgtatcgcgccagccgccggtgccgttcacatcccacttcgcctgcaaggggcgcatttcgccctcaccccaatagcgccagttccacacacccgaatcgggccaaaagttatgcgcgccaccatcaagatgcagagtaaaccggccaaagctgggatcgtgggcacgcagaattgcctgcaggcgtccggagatcccttgtgaggataaacgtatacctgccagcggccagcgcgcttcatcgacttccagcgtggagagtaaacgcccgcgcaggcgtaaaagcgctttgggtttaaccgtcagttgcgggttgagtaatgagccgttcagctcgccaggaatagtgccaaaaagctgcatcgcagagtatttgctttcacccgtcagctgtaaaggtagttggctttgcgtgaggctgagatgacccggccctattcccagtaccacattacctttgccgccgcgtccctgggttaacatattaagacgccccctgatctcggtggcatccaaaccggcctgccagttgttcagcgtcagattcacaaagccagacagcggttgcgccgcaagtggccagtaatattccccgcgttcaatcgttatgcgatcgcggctggcctgccagggaagatggagcaagggctggtcagttcccgccgtagtaatattgagcagaccacgctgatgctgccagcttaacgcggcttgcacctgctgtggaaaagctgccaacgccagcgtgccggtaatctcgccgttaacgggtaagccgttggcatattcgggcagttcgaagtgaccattaaggctcagcggttcgggtaatgccggatgcgtcaacgtcagttggctaatattcaactgctggccctgtaaggtggcatcgagctgcaagttggtgccgcggtagtgcaactgttggcgggatgaatccagcgtcaaattcagccccccggcataatcctgccagggagagagcgtgagtttgccaatatggatgtcagcgcccggtaacattgcctgccactgggccagcgttttgggcgcgtccgtcgcgttttccgtttcaggaagccgttgaagacattcgctctgtagcgtcacctgctccgcattaagttgccagcgcgagtgctgccagccaagggccgcgtgattgacactcgccagacgacagtcccccacctggtaatggatttggggaaacacgacctgtccgttgcgccagcgcggcgcgccttccagttcgacgcgcgtgccgacaggcagccaaatgccaaccagacgcggcagccactgtgtaatggtcagcaataatcccagcagcaacacaatcagcgccaggacagcggcgagacgtcgacggaaaatccgcggcatgaaaacaagaatcctttttttctcaatatcctgagaataatgatggcacgtaacgccgggaaggtgaaggtttcaccccctaaggtaaacaggtatcagcaaaaagtaacagaaaacgttattcttgttgcatccccttttcaggagcacaacgatgaaaatcgccgtatacagcactaaacactatgaccagaagtatcttgaacaggtcaaccaacagtatggtttcgaattggtcttctttgattttttactcagcgaaaccacagcgaagacggctgtagactgtgatgcggtttgtatctttgtgaatgatgacggtagccgtccggtactggaagagctggccgcgcttggcgtcaaatacattgcactgcgctgtgcgggatttaataacgtcgaccttgatgccgctgcggcgctgggactgcaggtcgtgcgtgtaccggcttattccccggaagccgtcgccgaacatgcggtgggactgatgatgacgctaaaccgccggattcatcgcgcttaccaacgcacccgcgatgccaatttttccctggatggcctgaccggttttaatatgcataacaaaaccgccggaatcatcggcaccggcaaaattggcattgccactctgcgcatattaaaagggttcggcatgcgtttactggctttcgatccctatccgagcgagcaggctttagcgctcggcgcggagtatgtcgatctgaaaaccctgtttgcacagtcgcacgtgataacgctgcactgtccactcacgccggaaaatcaccatttactgaatgcgcaggctttttcacagatgcgcgatggcgtgatgatcatcaataccagccggggaggattaattgattctcaggccgcaattgacgcgctgaaacagcaaaaaattggtgcgctcggcatggacgtttatgaaaatgagcgggacctgttttttgaagataaatcgaatgatgtgattcaggatgatgttttccgccgtctgtcagcctgtcacaatgtgctgtttaccggccatcaggcttttctgacagccgaagccctgaccgcgatttcagaaaccacgctggaaaatatcagtcagctcaaccggggagaatcctgtcaaaatcaagttaccgcctgacgcggtgggccggcaccatccggcctgcttcatttagcgtgcgcagttgccaccaatcaacgcctgctcgctgcagcgacggccattaactaactggcacatcccgatgcgcgaaccgtccagttgacttgaaaacgccagggtacctcctgcattggcacagtttgcctctgccatagacgacatcaccacgtgtggctgaacatgggcggcagtagcttgctgtggtggctcgttgtcgtcgctgttactgctacaggcagacagtagcaacgcggcaccagccagcagaaaagtagcggctttcatcaatcagactccgggaaggtgagttaaaggctaagcaagaatatgtcaggcctgacgcggggtcgatagaagaaacagctttttacaaaaaatatgacggctaattgcaagcagaattatcctgttatcacactgtcacgtaactgcacttatctaaacatgatgattaccggagaaaaacaatgttaatggatatgctgattcgtatcgccttggctgggattctgggcggtctgattggcctggaacgccagatgcgcgccaaagaagccggattgcggacccacatcctggtcggtatcggcagtgccatgtttatgctggtgtccaaatatggctttgcggatatgttgataaaagatcatgtcgccctcgatcccagccgcgtcgcggcacaggtggtgagcgggatgggctttcttggcgcaggcaccatcctgattcaaaaacaggtggtaaaaggcctgaccacggcggccggactgtgggttaccgccgctatcggactggtaatcgggagcggcatgtatgagattgggatttacggtacggtactggccctggtggtgctggaggtgttccgccgcctgagccatttattgattggcaaacatcacacgctgattgtttatcttaaggccaagagcgtgccactggtcctgctggtgatgcaacgcgaaggcattcgctacggtaatatttcggtgattaaccgggatgaagaaagcggccagtgtgaattaagcgtgcaggtgaccttgtcccgcaaatccagcgatgcgcatctgtatgacaaaattatggaagttaaaggcgtgcagtcgctggaaatgatgtaatcggtgtaggctggcgtcagcatatcgcgtttcatcgcccataatgtctccatcactttaccagcataaataaactggccttgccgcttcggtgaggccatcaataacccgcatgagggttttgctgtttggctgtggtcggtcttcatcgaacaggttagatgtcgattttacaatgtgccctgtgaagttaagaaaacatctgctgtggccgtgctcgtcgccatatgggcaaatgtcgtaatgtttcttgctgtctgcaggtgcgttagggattaactccctgataagggaatgatatgaagcattcctgtcgagatgtcactcaagacaaaaataagtcttcggaaaatacaccctcagcttttattaaagtaaaaaccacaatccaaaagttaatataagcgaagacttattcctgagatgaggttcattcaggaaattatggcgtagcagattgcggggttgtaaaatttcaaaattatcatggttcacatcagcgttattgccaccactgtcacgattagtgctctgacgaaaggcaatcctcattttttagtcacagggcattttactgtctccctttctttctgtaggcatacacagcttcatccactacctgtattaatcaatacatatcatttgtgagaattgtaatctctatgatgtataagtggttttttttggttaaagcatttgtgattgatcgttttcaccgatcgtttttgcataattgatctacacatacgattacacacacaaagtgtgtgtctataagattgaatggttgctgacacgagggaatgtatgatgacttatataattataactctggccattcttatagctgtaggggttgcattttggttaaaggatcgaccaggcgatagcccgcaatatcaggaaggcggctacgactaaatcaaatgactatcagcccggaataccgggctttttattatctgcaaccggcaaagctgatttgtaagcatcccggtaaaccgaaccattcgcttttagagatcttccgacatactgattatgtcctgtgaggagatcaccatgcgtaaagcccgattcaccgaacaccagatcattgccgttctgaagtccgtcgaagccggacgtaccgttaaggatgtctgccgtgaagccggtatctctgaagccagctattacaactggaaagcgaagtttggcggtatggaagcctctgatataaaaaagatgaaagacctggaggatgaaaaccgtcgcctcaaacagatgtttgctgatctcagccttgaatgccgggcacttaaagaagtcatcgaaaaaaagctttaaaaccagcgataaagcgtgagctcgtcggttacctgactgcgcaatttaccatgagcattcgccaggcctgcaggacgttatcgctgagcaggacggtctatttttaccagcccgatacccggcgtgatgaaccggtgatccaggtgctgactgagctggcagagcgctacccgcgatacggcttcaaaaaactgttccagctgctgcgcaggcagggtaacacctggaaccataaacgcgttcaccggatttactgcctgctgaaactgaattttcgtcgcaagggaaaacagcgtttacccgcgcgtaacccggcgccactggctacgccggaagcgcttaaccagagctggtccatcgattttatgcatgatgcgctggtctgcggcagacgcttccggacctttaatgtggttgatgactttaaccgcgaggccctcgccatagaaatcgatctgaatatcccggcacagcgggtggtcagggtgctggacagaatcgtggcaaaccggggttatccactgaaactgcggatggacaacggaccagaactggtctcactgacgctggcacagtgggctgaagagcatagagtgatgctggaatttatcaagccgggaaaaccaacgcagaacgcctttatcgaacggtttaaccggacgtaccgaacagaaatcctggatttttacctgttcagaacgctgaatgaagctcgggaaatcacaagtcgctggctgatggaatacaacagcgagcggcctcatgaatccctgaataacctgacaccggaggagtaccggctgatggccgtaaaaccggaaacctcaaaaagtgcgtggaactaaaacgggtgtgcttacagattcagcagcttatcagtttgaaagcaatcaacttggtagagtaattattctttaattaagtaacacggaaatcgctgaaacctcactctggtgcctgcgaccacacaggattcgccaggtccacgcgattgcgtaataccctgtaaacctcccaggctttaagactggattcttttcttcagttgccatgcccggccttagcgcccgctcagattggctggtaaatgcgttcgctttttgaatctttgttctgttttagtgcgagctatggccgatttcttttgcgcttcattatccgttcccacgtgccccattccctttatcaaagtctgttccagagctgaggagagtccagccatcgcgaacaggtacgatgtagtctgtctgaactgcctcagctgtttcagtgctgtaggcagtcattcccctgccatctcaaccgattcctgtttcagaccatccgcacttatggcgtaacacgcatcgctcatctttggagcgcagcagtaaaacgtgctggcattcgtcgccggaatccgtaccatacgcggcatacttttgcctgcaggctgtttactgccgctagcgcaaatccatcatttattacgagtcagctggggcatgaaaacgcgctaagggtttatgaagtcgatacttcgtggatacatgaactggacgccgatcaggtgcagatgctcaacagtcagcttgccctttaaaaacgttgccccctgcatgccccttttggttttagagattgaataaaatgcaacaagatcaggaaattaataagaaagagcagtacaacctcaacaaacttcagaagcgtttgcgtcgtaacgtcggcgaggctattgctgattttaatatgattgaggaaggcgatcgcatcatggtgtgcctgtcgggcggtaaagacagctacaccatgctggaaatcctgcgtaacctgcaaaaaagtgcgccggtgaaattcagcctggtggcggttaatctggatcaaaaacagccaggatttccaggtcatatcctgcccgagtatcttgaagcgcaaggtgttgagtacaagatcgttgaagaagacacctactctatcgttaaagataaaattcccgagggtaaaacgacctgctctctatgctcacgtctgcgccgtggaattttgtatcgcaccgccacggagctgggttgtaccaaaattgctctaggtcaccatcgtgatgacattctgcaaacgctgtttttgaacatgttttacggtggcaagatgaaaggtatgccgccgaaactgatgagcgacgacggtaagcacatcgtgatccgtcctctggcttactgccgtgagaaagatatcattcgtttctcagaagcccgtcagttcccgattatcccgtgcaacctttgcggttcacagcctaatctgcaacgccaggttatcgccgatatgctgcgcgactgggacaagcgctatcctggacgtattgaaacgatgttcagcgccatgcaaaacgtcgtgccctctcaccttgccgatatcaacctgtttgatttcaaaggcattcaacacggtgatgcggtagtcgacggtggcgatctggcatttgatcgtgaaacgctaccggtcaacccggttggctggcgtgccgatgaggaagaaaccccggctgtcagcgatcgtcttaacgtgctggaaattaagtaacgtttatctattggttaaaggcaaagggcacgcatcatgtcgcgtgccctttttttatacgttgcggtgagggggcgggtccattaccggcggaaactcaggatccggtggcggatcgggttgcggctgcggaatggggggcggatcggtcggaattggctcgctgctgtgtatcgccataatgccgttctcctctgtagcgaatggattttaagcttaggaaagaattgacatctcagccagcggacaaaaaaaagccggctagttagccggcgtatttcgaattaaaaatgctatgcaataattctaaaaaaggaagtaagacaatatggagcgcaacgcccatcgcttgacgttgcattcacctgcgggagagattttgcgcgctttgcgcatcgcagatattgatgtcgatcagctttagccctgttaatgtgattttcctgcgcaacgccccctgcacctcttcccacggccttatagccagcgtcgcttacgcagatagcctgctacacccaacgccagcagcacgagtaaaagacaaaagacgctaaaaccatagcgccatgctccgccgggaatgccgcccaggttaacaccaaacaggccggtcaaaaaggtagcaggcagaaagatcatcgccatcagcgacatggtataggttcggcgattcatggattctgccattaccgaggcgacttcatctgccagtacggcggttctggctacgccagcatcaagatcgtccagaccgcgtcccagtctgtcggcaatttcctgcatacgacggcgttcgctgtcgtccatccagggcagtttttcacttgccagacgggagaagacatcgcgctgcggtgccatataacgtcgcatcacaatcagctgcttgcgtaacaggcccagctcaccgcgcggtggaatacgctggtccagtaaggcatcttccagctcaatgattttgtcatgtaaatcttcgataaattcgctggtgtgaccggttaaggcatcgcaaacctccaccagccagctgccacagttaaccggcccgttgccgttttgcagatcggtcagcacttcgtccacggcaaacactttgcggcggcgagtagatacaatcagctgatcgttgataaaaacccgcatcgccaccagctggtcgggacgtgcgtcactgttgtggttcacgctgcgcagaacgatcataaaaccatcgcccaggcggttaacccgcgggcgcatgctttcaccggcaagcgcatcgcgcacggcatccggaatctggggcgttgactgcaaccattctgcgctacgcggatgcgtatagttgaggtgtaaccagcacggatgctcgtcgtgcagcaactgcgtttcgtcaatcggcaccatgccgcccttgccatccaactggcaggaaatgatggcatcggtcaccttcagcgcttttccttgaatcacatccacaacgtcaccccactatcaaaatcaatacgatacagtctagcgtgacgggattgagttgcaatcttcagcctgtatacaaaaatgtcaaaaggcggccgcacgtcggccgctatctcttaatgcttctctatccacagctcgcggctataggcaacgtcttcgggattggtaatcggataacccttcacccacggcttaatcagacgaccattggtgtactgataaagtggcgcgatgggtgcctgatcagcgatgatttgttctgcccggttgtagtcagcgttacgtgcctgctcactggtttccatgctcgcttttgcaagtaccgcatcatattcggcattgctgaaacgcggaatattgctgctgttgcctgaggtaagcagattcaggaaggtcgagggttcattgtaatcccctacccaggaggcacgaataacgtcaaagttgccactgttacggctgtctatgtaggttttccactcctgattttgcagtttcacgtccacgccgagattcttcttccacattgaggccaccgcaatcgctattttctggtggctttcagaggtgttatacagcaacgtcagcttgagcggcttcccggggccgtagccggcggcagccagcaacgctctggcctgggcatccatttctttttggttgtgctgttgctgcagcgtgggcagcggtttaaagcctgccgtcacgtccggcgtgaaatgccatgccggtttttcccccgtgcctaagactttttcggcgatgacggcgcgatcgatactccacgacagcgctttgcggacacgaacatcggcggttggccctttctgggtattaaaggcgtaatagtacgttcccagctgatcgggcgtaaagacctggcccggcagcgtctttttcaacagcgcatacatgttcttagggaaagattccgtgatatccacatcatcggcacgatagcgtttggtggcgctggactcttcattgatgggcacaaaggtcactttggttaagacggagtgggcgttgtcccagtaatgcggattacgctccaggacaattttttcattcacaacccgttggctgagttggtaagcgccgttgcccaccagtttgcccggcaacgtccactgcgcaccctctttttcaaccacagcttgcggcacaggataaaaagcaacgctggagagcatggcaggaaaccagggaaccggacgcgtcagcgtaatcctgaggcgatttttatccagcgcagtcacacccagcttatctggcggcatgtcgcccttggtgattgctgccgcattgctcaggccgctcagcgcaataaaggacgcctgggaagaagaggttttaggatcgacgacgcgctgccaactgtagacaaagtcctgcgccgtcactggttcgccatcagaccagcgggcattatttcgcagggtaacgatccagactttgttgtcactgctgctccagctctgtgccacgccgggcacaattttgccgtgcgcatcctggctggtcagcccttcatacagatcgcgcattacctgtatttcaggcagacctacggctttagcgggatcgagcgaggcgggctcatctttaatatggcggacaatttcttgtttagcggcaagttgggcaccggcgggaacatcggcagcgaagatcggcatggacgcgctaagcaggctcagggccgttagcgtcaacgaaaagcggattaccattatcacccctttataataaagaagcgctgaatcagcatattactgactcagcctgttaacggtcactttagcgcaaatcgctgattgataaatagctattttccctgacccgcttttccgctactttgacataaaccctcaggagaaagtcactatgtcatcccttcacccgcgaccgctacgcggcaaactggctatttcctggcagcagtatggccgttcggttctgggcgccccgctgctctggtttccggccgtgcaggcagacagcgacagtggcctgattctggccggtacgcacggcgatgaaaacgcggcaatagcggccctttccgctgcgctgcggacgttgccggaggcgcagcgtcgccatcatgtggtgctggcgatgaatcctgacggctgtcagttgggtttgcgagccaatgcgaaaggtgtcgatctgaaccgcaattttccagccgccaactggcagtcaggggatacggtttatcgctggaatagcgcagcagacgaacgggacgtaacgctgtcgacgggcacacatccggcatccgagccagaaacccaggcgctgtgtgcgctgattcatcagcttaaaccggcctgggtggtttcctggcacgaaccgctggcctgcatcgatgatcccgatcagacggaaatcggcgcctggctggcggcacagaccggtttacctcgcgtcagcagcgtgggctacgccacgccgggttcctttggcagttggtgtcacgacctgagtttgccgtgcgtgaccgccgagatgccggtcatttcggtggatgaagccaccgaaacctatctggagacgatgctcactctgctgcgctggcagccgtgatcaacgcaccgccctgcaccttaagggccggttcggcatcgacagccagccaggttgcaccgtctaaatcggcaaaacgcaccagcggcaccagcggcagtgcggcgcgaatcgcccttgatgtgcagatcatacagcccgccatgagcgtaaagccctgctgttgcgcagcatgcgccagggctagtgcttcggtcagtccgcccgctttatcgagtttaatattcaccatctcatagcgcccacgcagcgcaggcaggctttcacgcgtgtggcagctctcatcggcacaaatggggagaggatgaatgaagttcgccagcgcctcgtcttcccctgccggtaagggctgttcgagcatagcaacctcaagatcggctaatagctggcaacgcgcggccaggccctcagcgtgccatgattcattagcatcgatgagtaatgtcgcctccggtacggcggcacgaatcgccatcagccgctcggtaataaagttattatccattttgattttgagcagggtggcgccatgttgccataaggcctgcgcactgctggccatcgcctccggtgtatcaatactcaccgtgtgagcagtgatcacagaacgggtcggttcgacgccaactaactgctccagactccgatgctgctggcgtgcagcaagatcccagagcgcgctgtcgatggcatttcttgccgcgcctgccggcaacaggttctgtaagtcatcacgtgacaacccctgctgcagttgtggcatgacggtcgcaatttgctccagcaccagtgcttcgctttcgccatagcgcgtgtaaggtgtggcctcaccaatgcctttcacgccatcttcttcaatttccacgacgacgactttagcttcggtgcgagtgccacgagcaatgacaaacggcgtgtgcagcggccatgcttcgggataacattttaccgttctcattacctctccttattgtcggtgattcatcactgtcatttaactttaggcaacaaatgctctcgtaaacccttaaaatttatgtcataaacaatggctatacctgtactgacgcgttatttttgtcagatcacatcattagaaggaatgcttatgtctcagactgttcactttcagggcaacccggtcgcggttgcaggtcagttcccgcagccgggcgacagcgttaaatcgtttactctggtggctaaaaacctggctaacgtctcactctctgagtatgcaggaaaacgcaagattctgaatatttttcccagcgtcgataccggcgtgtgcgcctcttcggtacgtaagtttaaccagctggcgggtgaactgagtaataccgtggtgttatgtatttccgctgatctgccctttgcccagtcgcgtttttgtggcgcggacaacctgaacaatgtggttacgctctccacgctgcgcgggggtgaattcaaacgtgattttggtgtggaaattgccgatggcgccctgcaaggcctgactgcacgtgcagtgatagttctggatgagcatgacaaagtgctttacagtcagttggtgaatgaaatcaccactgaacccgattatgactccgcactcgctgcgctgaaataatgaccacagcggataagccagacttatccgctgcgtttgttttattcgctgtcgccgcgtttttgacctaaaccgtactctcgcaatttattggcaatagccgtatgggaaacgcccaggcgttttgccagtttgcgcgtgctgggatacgaaaggtataaacgcgtcagaattgaccgctcaaagcggctggtgatctggtccagcgtcccttccatcgcctcttccccgagtgacacatccagtgcctgttcaggtaaaacgatatcctgaggccgtaattcgtggccttccagttgcgttaaggcacgatacagcgcgtttttgagctgacgcacgtttccgggccagttatagcgcatcagaaaagcattcagctgtgaggacaaccgtggacgcggaatgccctgttcatcggcgaagcgcgccacaaacatgtccgttaacggcataatgtcctgaacccgctcgcgcaggggcggcaggtttagcgtcagcacgttgagccggtaaaaaaggtcttccctgaattcgccacgttgcaccagctcaaacagattcttctgggtcgcgcaaatcacgcggacattgacgtgaacttcgtgctcttcacccacgcgccggaacgtgccgtcgttgagaaagcgcagcagtttggtctgcatggtcggcgacatctcaccaatctcatccagcagtaccgacccgccgttggcctgctcgaaaaagcctttttttccctcaagcgcattaggataggcacccgccgcatgaccaaaaagctcactttccgccacatcatccggcagggatgcgcagttgagggccagaaaaggcattttcccgcgagcgctgcgtaagtggcaggcccgcgccagcatatctttgcccgtaccggtgtcaccgatgatcaggagcggcgcatcatgcatcgccagcttgcgcgcctgttccacgacctgacgcattttgggcgtgaccgcaacgatatgatcgaactcggtttcgtcggtgacgaccagactctgcaactggcggcccatgcgagcggtggacttcagcatcaccatcgcaccgacaagctgttctgcctggtcattttcttctgacaggtagatcggatgcgcttccatcaggaaatcgcgcccttctatcaccacatgttgtgcctgagcctgaacgcggtcgctttccagccagcgcataaagttgaagccgttgatcagatgatcggccgtcacgttgcggatcttgttttcatcaagattaaacaggttttgtgccgccgggttcgccagctcaaccttacttctcaggtccaccgaaaacaccggctccggcatggccaccagtaaggcgctcagaacccggtgctcacgttcggaaggcatatagggcacagtgcggacatcagtcacgcccggcgtacggcggatttccgccatcagattactgaactgttcgaattccagcgtagagaaattaagatagatgcggcctgaggcggcgacttcaatgccgcgaagatcgatgctgcgcgccaccagcaggtcgagcaattcgcgcgccagcccgatacggtcctgacaaaacacttctaaacgcattgcgtaggccttaatccgtttgatatttggcgataatacgctaaataacctgcccgcagaaagagggctgtcaggaaaagttgacagcggtgacgcacgcgcatttttttaaacgcgtaaacggcgtcagccaggatgacagccttacgcgtgctgagtgggtcagaaatgaacacgcaccggcaggcatggcacaatacagctgatgcgcgttcgttcacgtactgcagaatgacatgaccgcgccgttgggccacagcgctcgtcatcctgtttcatttactggcgtttctcaccgcccttttgtagcgcgtcttttaactgtcccaacagctcacgacggtaatcacccaggcgcggtttatcgttttcgagccagggtaaggggcggcataactccatcgctttaatgcccagacgcgccgtcagcaatcccgcgccgatgccctgcgcagcacgcgtcgaaagcctggcggcaatgtcctgcgacatccagtccatcccaacttcacgcaccagctcagaagccccggcaaaggccatgttcagcagcaccagtcggaacaaacgcaatcgactaaaataccccagctcaatgccgtagatggcggcaatccggttgaccagtcgtaagttacgccaggcgataaacgccatatcgaccagtgccagtgggctgaccgcgatcatcagcgcggattcggccgcatgacggctgatttcccgccgcgcctggcgatcaagaacaggctgcaccatctgggcataaagccggaccgtttccccgtcattgtgggtttcatggcgcgcagcatgccagcgctgcaaggcaggatgcgcctgatcgagttcggcctggcgtgccagcttttcacaaaaggcacgtcctttcccaatgccgtgactgttgagcagttcccggcccagatcgcgctcttcggcccgctgacggagctgatacaaacgacgccactcgctggtcagcgcgcccacgccagcaagcacaatcagcccgcccgccatgccgctgcccagcgcaaaccagtcgtgagccagccaggcattgtggctccattgcacgccctgcgccaccacgctgacgccaaacagcgccaggccagcgcccaccattttacgccacaggctgcgtttgggttttaaggccgcctcgaccgcccgctcgcctgcaccttcttcttcaaccgccgcctcgttatcctgcacggctaaaaaggcggcctgtgaatcggcttcaaacgtctgagccggacgcaacaccgcgtcgggcttatcgtccagaggccgggcaaaatcaatgcgcggtttcaacggatcgctcatcgcaatttatctcccagtaaaaattccagtgccgcatccatgcggatatgcggtacggggcgatcgatatccagctgctgcgggcgaaactgctcaaactgaaagccttgctgctgccagaacgcgctgcctggcagccgcggcggaacctcacccggataaacggttaatgcctcgccgtcctgcaggcgatgacctcgtagtgccggaattttttcgccacgatgatcgaccagcccgctttgcgtggcctgaaccgaggccaggccgatgcagtccatgctgatgccttcgaacgccgcgttttgccaggcatcctgcaccagctgctgcaacagcgagaccatattgccgtgctgatcgctggtgatgtgatcggctttcgtggcggcaaataacagcttatcaatcacgggtgaaaacagccgccggaacagcgttcgctgtccgtaatgaaagctctgcatcaactgggttagcgccaggcgcatatcgttaaacgcctgcggcccgctgttgagcggctgcagacaatccaccagtacgatctggcggtcaaagcgcagaaaatgatttttatagaaccctttcaccacgtgctgacagtagtaattaaatcgctgctgcagcatggcaaagttactgcctttgtccgcctgcgccagcttagcctcctgggcttcatcagctgtcggccacggaaaaaactgcagcgctggcgcgcccgccatctcgccaggcagcacaaaacgccccggctgaataaagtgcagcccttccgctttacaccgatgcaggtaatcagtccaggctgcggcgatcccggccaggcggttttcatcggcgggggcaagcggatcgagtttttgacaatgttcgcgccagggtgcggcccagtctgcgcgatcgccctgcattaagccgttcatctgccgcgaccaggtcaggtaatcctgtgccagcataggcagatcgagcagccactcacctgggtagtcaacaatttcaagatagagcgtggcggtatctttgagatggcggagcagtgaatcattgggacggtaacggagtgccagccgcatttcactgacgcctcgcgtgggcgtgggccaggcgggcggcgtactgtacagctgcgccagcccttcatcataggtgaaacgggcggtgcccatgtcccgttgcggcacacgtttcacgcccaacaggcgctcatcgcgcaccacagaaaacagcggcagtcgtgcgccgctgtgtacagaaaggagctggttaaccagcgaggtaatgaaggccgttttaccactgcggctcagtcccgttaccgccagacgaagatgtcgatcgacgccgcggttcatcaatgccagcaactcagtttgcagtcttttcatctttctccttgatgaagcgtgatgcaacccggctcatcacgcgtttcagcagcggctcaagcgccagtcctaacagaagacgaagtggacggcgcgccaccgattttacggcccagccagtcacgccagcaggaccataggttaccgcattgataatgataaatttggcggctgacttcaatgcaggtgttgcacgatgacgaaaagccgcagtgcgtgaaacagtcatcatttcctcctgacggtccgcagagggccagtctggcccgccgcaggacaacggttaaatctgacggaaacgactgcgcacgctaaaggtttcagaggtgacgtaacgttcgatgtcccggacattacgttcgtcctgctgcagtgcagtttccagttggtccagcaattcgccggggctgggttgatgttccccgttgtctgcgcctgccggtttgacgtccaggacaaaacccaacacgaaataggcaatcaccgtaaacacgaacagaccaaagaacagcgacaatacgacaatgacacgaagcagtcgcaccggcacatcaaggtattcggctaagccggcacaaacccccatcagtttcccttcgtcaggcttgcgccatagcgtgcggcctttcatcatggttgcctccagttaggatgttcagcatcaaggatggcttcaagggcatcaatacgatcccgcatgcgctgtgcatctttggtcacctgttgcaggcgctgcatctggctttgcgacagatctgccccgccgttgcgcttgttactgtaatgtagccatagccagacaggtgccacaaacagcacaaatattgttaaaggtatggctaaaaatagtgcgctcattgactctccttaatcctttccagcagaaagcggcttattattcgctgcggttcattttggctttcagcgcgttgagttgttgactgatttcatcatccgctttcaggtcggtgaactgctgatccagcgttttaggtttaccaaaaccgtggctctctgcttccgcttccatgtggtcgatgcgacgttcaaatgattcgaagcgggccatcgcctcatcaattttaccgctgtccagttggcgacgcacatcacgtgaagaagacgcggcctgatgacgcagcgtaagggcctgctgacgtgcacgggtttcgctcagctttttctccagctcagtgatttcacctttcatacgcgccagcgtctcttctacctgcgcaacttcctgcttcagcgaggcaatcagatcggtcagtttctgtttttcgattaacgctgaacgggccaaatcctctttatctttacgcagggccagttcggctttgtcctgccattccacctgctgaatctcggcctgttcgatgcggcgtgacagctgtttcttttcagccagggcgcgggcagaggtggaacggacttcaaccagcgtgtcttccatttcctgaatcatcaggcgcaccagcttctgcggatcttctgcacgctcaagcagtgaattaatgttggcattaacgatgtcagtgaaacgagaaaaaatacccataatgatgttcctcttatttgtcatggtttcatcttgctggtgatacctgattcaagatgcgtgccaacttttatcttattgattttatttgcattggtggctttgcagtttttttaaactgttctaagatagttaaattgattaatccgtggcgaaattcatcatgtccgttaataacgacaacctgctaggggaatcgaacaactttctggaagtactggaacaggtgtcgaaactcgctccactggaaaaacccgtattggtggtgggtgaacgcggtacaggtaaagagctgatcgccagccgtctgcactatctttcagaccgctggcagggccctttcatctcactcaactgcgctgcgctgaatgaaaacttgctggattctgagctttttggccacgaagccggggcatttaccggtgcgcaaaagcgtcatctgggccgttttgagcgtgcagacggtggcacgctgtttctagatgagctggctaccgcaccaatgctggtacaggaaaaactcctgagggtcattgaatatggtcagctggagcgcgtcggcggcaaccacgtctttcaggttaatgtgcgcctgatctgcgccaccaatgaagacttaccggcgctcgcggccgcaggtcagtttcgcgcagacctgctggaccgcctggcgtttgatgtcgttcaactgccgccgttacgcgagcgccgtagcgatattttggtcatggccgatcatttcgctatccagatgtgtcgtgaactggggctgcccctgtttccaggctttacacagcaggcgcaaaacaccttacttgatcatcactggccgggtaatgtgcgtgaacttaaaaacgtcgttgagcggtcggtgtaccgccacaacaccagcgatgaaccgctggatgagattatcatcaacccgtttgcgcgtcgtacggcccctgaagaagctccgcttcctgccagcacgccagatgcacccgctgccctgccatctctgccgctcgacctgcgccagtggcaaaaccagcaggagcgcgatgtggtggaaatcagtctgcaacaggcgaaatataatcaacgccgcgctgccagcttacttggcgtcacctaccaccagctcagagccatcatgaaaaagcacggtatccaggcgcgggacgtccaggcataacggacgatcgaccggattagattgcagataaacgctgggttgttgctgtggtaagcaatgatcattgtacggctgagaccgggcgggtggagtcaaaaggatgggggcgggaaaaaagggcccgccgaagcgggcaactggaagcaatgtgagcaatgtcgtgctcttcttcggtagagccaccgtcgaatcgcaactgaataataatcattcctgttcgcatctgtaaaggggttgttgagaatttttctcatttccacaccaatgctgcgcctttattaccacgcacccgtcgcctttaccctgctgcaacgggctggtcgcgcttcacattgcattgcattcaacaaggtgacgacggtgatgcctttcgcgccgccaacctggccgaacccgcccgggtacaaccccatcggaatcgggccaggaagcattagccgcttctttctacgctcaggtgcgcgaaaaaccggcaatcgacgatgcgtatttggggccgcgcccgctttgcgatacactctgcctaatgcctgagaatcgttgagttctatgttaaaactaattccttcgctgttactgagtctcagcgtgttaagcgcgcctgcctggtctgcgccaacaccggctggagatattcgtcaaagcggattcgtctattgcgttaatggcacgctgaacacgtttaatccgcagatggccagcagtggcttaacggtggatacgctggctgcccagttatatgaccgcctgttggatgtcgatccttacacctaccgtttgcagtccgatctggccgccagttgggaagtgcgtgataacggcgcgacctaccgttttcacctgcgccacggggtacagtttcagcacacctcaaactttgcacccacgcgcgcgatgaatgccgatgacgtcgttttcagctttgcccgcatgtttgatcgcaaacatccctggcataatgttaacggcggctattacccctatttcgacagcctgcagtttgccgattcggttcagagcattaaaaaaatcgataacgacaccgtcgagttccgccttaacagcccggacgcctcgtttctctggcatctggcgacacattacgcgcccgttctgtcgaaagagtacgccgacagtctggacaaagtgggccatcaggaagagctggaccggctaccggtgggaacaggcccgttccagctgagcgaataccgcagcgggcaatatattcgtctggcgcggaacccacattactggaaaggcgtgccgcgcctgcagcaggtggttatcgatcttggtgccggaggaacaggacggttatcgaagttgctcacgggcgaatgcgacgttctcgcctatcccgccgccagccaaatctcgattctgcgcgacgatccccggctgcgcatgaccctgcgccccggcatgaacatcgcttatctggcttttaacacccgcaaaccgccgctcgaccggccggacgttcgtcacgcgctggcgctggcgattaataatgagcgtctgatggaatccatctactacggcaccgctgagacggccgcctcgattttacctcgcgcgtcctgggcttatgataccgatgccagcattacgggtttcgatcccaaaaaagccagagaagcgcttggggcagcgggagtaaaagatcttcatctgcgtctggttgtgccttccgcctcgcagtcctggaacccagcaccgcttaaaacggccgaacttattcaggccgatcttgcgcaaattggcgtgcgcgtcactatcgtcccggttgaaggccgttttcaggaggcacagctgatggcgatgaaccacgatctgacgctggcaggctgggcaaccgacagtaacgatcctgacagcttctttcgcccgctgctgagttgtgcggccatcagttcccagaccaactatgctcactggtgttcgcccgcgtttgacgacacgttaaaaaatgccttgctgtcacagcagttgtctggccgcattgataactacgataaggcgcagcagattctggcgcgcgagctgcccgtgctgccgctggcttcatccctgcgcctgcaagcctatcggcatgatattaaaggtctggtattaagtccgtttggtaacgcttcgtttgccggcgtttatcgtgatgagcgagaggatcgttaagtgatcatctatattctgcgtcgcctggtgttgctggtcattaccctgttttttctttccctggtgagtttcagcctgagctatttcacgccgaatgcaccgctggaaggcgcatcgctgtttgacgcctggtggttctggtttaaaggcatgctgcagctggattttggcgtgtccagcaccaatggtcaggagattggcgtacagctgcgcgaagtcttccccgctacgatggagctgtgcctgatggcgttcaccctggctctgatcgtcggcattccgttgggaatttgtgccggtgccatgcggcataaatggcaggataaggtgatcagcgcgctggccctgctgggattttctattccggtgttctggctcgcgctgctgtttaccctgttcttctcactgacgctgggctggttgcccgtatccgggcgctatgacctgctgtatcctgttcaaaacattaccggatttgcgttgattgatgcctggctcagtcactcgccatggcgacatgagatgatgattagcgtactgatgcatctgattttaccggttaccgttctggcgatggcccccaccaccgagatcgtgcgtttgttgcgcatcagcaccagcgacgtcgtcgataagaactatgtgaaggcggccgccacccgcggattatcccgctttaccgtgattcgccgccacgtattacacaacgcgcttccccctgtgattccgcgtcttggcttacagttttccagcatgttaaccctggcgatgattacggaaatggtgtttaactggcccggattggggcgctggctgattaacgcgattcgccagcaggactatgcggcaatatccgccggtgtgatggtgaccggtggcgtagtgatcgtggtgaacgtcctctctgacattgtcggtgcggcgctgaatccgctgaaacataaggaatggtatgccttacgataacatctacgccgaaaagcgcctgcccagcgcgtttcgtcaaagctggcaccatttttatggcgatatgccggcgatgattggcctgtacggctttggcgcactgctgctgctctgcctgtttgggcatttcctggcaccctatcccatcgaccagcaatttctgggttatcagctgctgccgccctcctggtcgcgctacggtgaagtctcattttttctcggcactgacgacctggggcgtgatttactgagccgcttactcaatggcgttgccccgacggtaggttctgccattctggtgacgctgtttgccaccttttgggcgctggtgctgggcattgtggcgggtatgacgcacggcgtgcgctctgcggtgctgaaccacgtgctggacacgttactgtcgataccttccctgctgctggccatcattgtggtggcctttctcggccctcgtcttgaacatgcgctgctggcggtgtggctggcgctgatgccacggctggtgcgcgaaatttacagcgccgtccacgacgaactggaaaaagagtatgtggtggcggcccgtctcgacggcgcgaccagcatcaatattatgtggcacgcgattttgcctaatgtgttaccgatgttgatcagtgagattacgcgcgcgctctccatggctattcttgatattgccgctctgggttttcttgaccttggtgcccagttgccctcgccggaatggggggcgatgctgggtgattcgctggaactggtttatgtggctccctggacggtgatgttgcccggtgccgccctgatggtcagcgtattagtcgttaacctgctcggtgatggcattcgtcgggccgttgaggcgggagtagaataatgccgttactggatattcgtaatctgacgattgagttcatgaccgctgatggcccggttaaagcggtggaccgcattaacctgtcgctcagtgaaggggaaatccgcggtctggtcggtgagtccggttcgggcaaaagtctggtcgccaaagccatctgtggcgtgaccaacgataactggcgtgttaccgcagaccgtatggtatttgatgacgtcgatctgctgcgcctgtccccgcgcgagcgacgtcgcatcgtcggtcataacgtttcgatgatttttcaggagccgcaatcctgtctcgatccgtcggaaagtgtcggccgtcaactgatgcaggcgattccgcgctggacctataaaggcgcgtggatgaagcgcttttggttctggcgtaaaagccgggctattgagttgctgcatcgggtgggcattaaagatcacaccgacattatgcgcagttttccttacgagttaaccgagggcgaatgccaaaaagtgatgatcgccatcgccctggcgaatcaaccccgcctgctgattgctgacgagccgactaacgcgatggagccgaccacacaggcgcagatatttcgcctgttgagccggcttaaccagaacaataacaccaccattttgctgattagccatgacctgcgaaccatgagccagtgggcaaaccgcattaacgtgatgtactgcggtcagaccgtagaaacggcgcaaagcgaagacctgatgagcacaccgcatcatccttacacgcaggcattgattcgtgccatgcctgactttggtcgtccgcttccgcataagagccgtctcaataccttatccggtgcgattccatcgctggaaagcctgcctatcggttgccgtctggggccgcgctgcccctacgcacaacgcaaatgtgtagaagcgccacggctcaccggcacgcgatcgcacctgtatgcctgccacttcccgctcaacgttgagggccaataagatggaaacgttgctggaagtccgcaatctcagcaaaacctttcgttaccgcaccggcctgtttcgtcgtcagcatgttgaggcggtgaaatccgtcagctttacgctgcgtgaaaagcagactctggcgattattggcgaaaacggttcaggcaaatccacgctggcaaaaatgctcagcggcaccgttgctcccagcgacggtcagattattatcgacgatcacccgctgagctttggcgattacggctatcgcagccagcgcattcgtatgatcttccaggacccatcaacctcgctgaatccacgccagcgcgtgagccagattctggacctgccgctgcgcctgaataccgatctggacgctgaggcgcgggaaaagcgcattattaccaccctgcgccaggtgggattgctgcgcgatcacgccggttactatccgcatatgttggcaccgggccaaaagcagcgtcttggcctggcccgtgcgttaatcctgcaacccaaagtgattgtggccgatgaggctcttgcctccctggatatgaccatgcgttcacaactggtcaatctgatgctggagctacaagaaaagcacggtatcgcttacatttatgtgacccagcatcttggtatgatgaagcatatcagcgataaagtgctggtcatgcatcacggcgaagtggtggagcgcggcggcacggcagacgtgcttgcgtcgccactgcatgagatgacaaaacgtctgatcaacagccattttggtgaggccttaacggctgaagcctggcggcgggagcgttgattttgcggcatatagtggaaaacgctgtgcgtttttcctgatttcaagcagacgtgctagaatccgcacgtcgattaacgtcggtcgtctattatttaaacaacacgaccgccaactaccatgaccataaggattacagctatgggttttctttccggtaagcgcattctgattactggtgttgccagtaaactttccatcgcctacggtattgcacaggcgatgcgcaaacagggcgcagaactggctttcacctaccaaaacgacaaactgaaaggtcgtgtggaagagtttgccaaagatttgggttccgacatcgtgctgccttgtgatgttgcagaagatgaaagcatccaatccctgttcactgagctggcaaagacctggccaaaatttgacggtttcgtgcactccatcggtttcgcgcctggcgaccagttggatggcgattacgttaatgccgtaacccgcgaaggtttcaaaatcgcgcacgacatcagcgcctacagctttgttgcaatggctaaagagtgccgtgccatgctgaacccgaacgctgctctgctgaccctgtcttacctgggtgcagaacgcgctatccctaactacaacgttatgggcctggcaaaagcgtctctggaagctaacgtgcgttacatggctaacgcgatgggtccagaaggcgtgcgtgttaatgccgtttctgcgggtccgattcgtacgctggcagcgtcaggcatcaaagatttccgtaagatgctggcccattgtgaagcggtaacccctattcgccgtacggtaactatcgaagatgtgggtaactccgctgccttcctgtgttccgatctggcgggtggtatcaccggtgaaatcgttcacgttgacggtggcttcagtatcgccgccatgaacgaactggaactgaaataagtttcctcacgggcgagccttgctcgccctgtgctgtacccgcccgattgcctcgttattccttatcgctattatttatcaccgattggtcttttgccctgaactgcccgtgggcgacgataagtcagccctgcggcctgcgactaaatcaccgcctgcgccgcatcagattttgcaaaaggacggatgatgcaacaacgccgctatcccggccaggatcactggttttacgaaagtcagacccgcccgcggaccgtacaggctgccccactttttcctgaagccgcccatgtcgatgaccggtttttactggggttagcacaggaagcctccgttattcagcctttactccagacagaccagcccgcgatacagatcgcccacaacgtcgttctccggctgtttcctgaccaggtgaataccacgctgacgcatacgctcacgctgtatgatcggttaagtaccgcgctgaccgtcgcccaggtgacaggcattcagcgcctgtgtaatcactattccgcccgactgaatcccctgccgggtccagattcctcccgtgaaagtaacaatcgcctgacacaaattacgcaatatgcgcgcttgctggcgatgcagcctgcgctaatcacggctgaaagtattcgtgcgctgcatgcggccgggctgagcgaagccgatatcgtcacccttaaccatttagtgggctttgtctgctatcaggcgcgcgtcattgccggtattcatgctctgctggaattgccggtacgctggatgccggggatgtcacctgccccggatgccgaggcagcgacgtttgatcagccctggcagtggcagccggtcctgacgccgctggagccgcgttatgccagtgaggagcaacatgctgcggtcacgcagtgccagggctcgcccgcacttcaggatgctgtctggctgctggcgcacgctgccgggttattgcagagctggtttgccctgcgtcatgagcttgaaaatacgctgacctcatctgtagaggccactgcggcaaggattctgggcagccgctggctctgtcagcaggctacagacgctaaaaatctgctggatgaagtggatgcggcgcaactgccgggtgaacagcaagtgattatgaccctggccgcgcagttgacccgccagccggagcgctttaacgcgcgcgatcttcagccgctggctgacgcaggctggtcacatgccgcgcggttcagcgtgattcagtccatcgcgctggccaactggaacagccgtttattttatgcctgcggtgaagcccgctagctatcgagatgactgcgcgcttcatcgtaaaaatgttgcgccagcggcgtcgcccggccaggttcggcgacgaccagcgccgcctggcgcgccattttaggcattgcaatggtccgtttttccagtccatgtaatgaggcgggcagtaaatgtcctcgtggtgagatcagcacgccaagaccgacctgggtgcactgtaacagctgcatgatggacgcgctttcgaccaccacgcgcggcaccagcgcgacgtcgcgaaacgtcatatccagatagcggcgaaaatagcgggttggctccgccagacacagcggctgctgtgccagcgttggcaggtcaagcgtttcatgcgcgcataagtgctgaaaatggtcgggatgaaaaacggcttccacgccactatccggcagcagggatgcctgaaaatgcagttcccgcaacgtcgccatttcaaaaaagccaatgcccacatcgaccgtatggctgttcagcgcttccagcagttgatcggcgcttaatacggcaatacggtaatccagctgtggatagcgcgcctgcaccgcttttaacaactgcgccagcgaaacgctgcactgcggaacaacaccaagacgaagcgtaccgttcaccccgtgttttaacgactcgacctccagcttgagtccctgataaaccgaaacgatttcccgcgcccaggccagtaccctgtcgccttccggcgtaaaacccgcaaaattgttgctgcggttgatcagcgacagacccagctcacgctccaggttttttaaccgcatcgataaggtaggctggctgacaaagctggcttcggcggcacgaccaaaatggcgctcgcgttcgagattgcaaaggtagatgagctgtttgatgtcgattttctttacccgccgtaacaccgtttttatgaatacctattatgtgccgatggattaacagaatgccagtcagagatagtgccgtaaccaataccgcgaaggccttaaacagacgcaacatattcagagcgcaataaggttatgaaggtggctgtcacaatggcaggtcagataatcgggggagcgttgtcagcattcacaggtgaataccggtgttgatgatcttataaacgcattaatttgtaatttttattggtgtttccctggtgttgcaggtgcttacttgtgcggataaggccaggcgtgatcaatgccggtggaagagagaacgcccgtgaccaataagtagatcaccaccaaagcgaagataacaattgctgatatttcaaagattttaatcagactgtgtttagccataaataaccccctgctcattgcgtgtatttgacattcatctcttaccttagagtgttaccggtaaagtacaagtcccgatcacaaaatgaaacataaagtattacttatgtattgtaatgaatttgttaaagtcatagaaaccgaacgtgaggagagaccgttgacgggtattatggtgaaggctgatgacgcactaggctttcgaacgccaaagcacggcagctgcggagactgtaattaaaattgtgtaattgcctgttttagtgtgttcactccccctgcccatacaggcaatttattaacaaaaaacataaccccccctgtggctgaactggctaaatcaaaactaccttgttgtgcgatgacggcgagatggaattgaacacgcctcgtgaccgtgaaaacaccttcggaccgcagttgattaagacgcatcaaaggtacgtaacgcacctggacagccggatcttattcctttatgccaaatgcatgaccatccgcaaaatcgttgccaccttcaaagaaatttacgaagccgatgtgtcacccatgctgatatctaaagtcatcgacgccgtaaaaagtcagtcaccacattctgcccagctcttttttacgggactttttttctgtcgatgacgggttttataacgtgacagtatgagtagtaattaaagccaacttcccggtaatatcttttctggttcgaactgataagggattttcaagtgaccattaaattttcccagctctgggaggcacaccctgaggtaaaaggcgatgccaatccatgccgcaaacccgatggacataaagcctttgatgaccagtgcgcaatccgtattggcactgcattaacccgctgcggatacgatgtaagccgcctgaaagtagcccagtgctggtatcatcctaaggaggctggtcatgtgctaagggctgaagaactggccaacgccctaaagaaaacggcaattccgggtgttttcagtgcggtgaaagtaaaccctgaaaacttcgaacagacgctgcgcggacagacaggcatcattttttttaaagattactggcgcagaggaagcgagagctttgctaaccggtcaggagaccatatcgacctgtggaatggcgagcgagtgacatcaagatcaagctatctccgaattcagtggggactacactgggaaggtgtgctcagcgatttcttcaactcccgtgaaatctggttctggaagattatatgaagcgttctttgcaaatatgtctggcgtcattggctggcctggcggttggcgcgggtctctttattattgtattcccatcacttgcccgcttcattaatggcccggtaaagggtgaagatcaaatgtctgcgaacgcagcacttttattcatcggcttacctgcaaccgcaatcatctttgctgctgtgacaggaacctggtgggccatacggcttaaaacgaaagcgcagagcggcttaggatgacgttgaaagccagggcgtttattgggtgaatccttgcacgattatcaggacggtgacggggaagataacaagagcgcttaaagagagctgccgtaggtacaggctgggacggacgttcgataattgttttatcctcaaaatcgaacgaccggtatcacttgctgaagggactggcccccacttgtacctttactgggtgaatggtgattacccgacgcccagggccgctttcacctcttgtgcaattttctctacctgcgggccgtaaatcacctgcacatcatgttcactaacgcggttgatgccattggcaccggtgctcattagcgtctgatccaccacttctttcatgtctttgacccgaacccgcaaacgcgtgaagcagcaatcgacatcctctatattggctgcgccacccagaccactgatgatcacgttggtgcgctcgctgccttcaaccagctgtggtttttcatcatccgtttcacgtcccggcgtttcaacatgcatacgggtaataataaagcggaaagaatagtaataaaccggggcgtaaatcaccccaagcgccagcgtccaccaccagtgggttttactgccgccaagcatgccaaagaccaccagatcgatcacaccgccctgcacatttccaatcatcaaatgcagcatcgacatcagcataaatgacagaccggttaaaaatgcatgcagcaggtagagcaccggcgaaacgaagataaagcaaaactccagcggttcggtgatgccagtagtgaatgacgtcagtgctccagccatcaccagcgccctgacgcgctgtttgtgttcaggccgcgcggtgtgataaatcgccagggcagcagcaggcagaccaaacatcatgaccggtatttttccctgggccaggaactgggtggcggtgcgaagcgtcgcgtccgggataagtccgggatgggtgagcgaggcattaaagatgtttaacgcaccgacaatcgtctgtccgtccacgatagccatgccgccaatgggcgtgaagcgcacggtttcgttcaggatgtgatgcaggcccgtggggatcagaatgcgttccgaagcccccaacagaaatgccccgtactgcccgctccggccgatcatctgtcccacccaggcaatgccttcgccaatggtcggccagaccagcgccagtaagatgccgatcagcggcaggaacaccaccgtcacgatcggcacaaagcgacgcccgccaaagaaactgatcgccgtgggtaactgctgcgtataaaagcggttatgcagcatcacggtgatcagcccggcaatcacaccgcccagtacgctcatattgtaggtaaaaatacccagcatctgaatgtactcagccgaggtcatcatggctgtggtctgatccagcccggcctgttgcagcgcctgcggcgtggttgtggctgcggtaatgcccttcgccgccagcgtggcattgataccgacattcatggcgatatagccgataacggcggcaaaggctgcggtaggcttttctgctttcgccagtccaatggcgctggcgacggcaaagaatagcggcagattagcaaacagcgcgccggccactttacgaataaacccgatgatgagctgggcaacctgcatgtgtgcgaaagcttcgccggtgacggcgggattctgcattgccgccgccagccccagaaagataccggccgctgcgatcaccgaaatcggcatcatcaacgccttgccaaacgcatggatctggctggtgagttgtttcatggtgtcgcgcccttttctgttttaaacagcaagtattagcgcgatgtgccgataacacccgttatggagaggttacgagaaggtaaaacatgaacatcatcacagttggcgcgccaccacgataaacgccagctatcgcaccattaagccaatcaattagacaagctttgtcgtcgatagcacactaatatttaccatcaggatatatccttgcaacattcgaccaacataaaaataagcctgcacctatgatgaaattcaagcgtcaaattaaaccataccgtgccgcagcgggcggctggggttcactggaagctaccacacgttttgttttcgacagtaaagctgccctgaaaaatctgcgcaatttaatgcgcatgaacaaagctcgtggcttcgactgcccaggctgcgcctggggcgatgataataaaagtacatttagcttttgcgaaaacggggcgaaagccgtgacctgggaagcgacgcgccgcgtggtcgataccgactttttcgcgaaacacagcgttacgacactgtatgcgcaaagtgactacttcctggaatatcagggccgtctgacgcatccgttacgctacaacgctgaaagcgaccattacgaacccatcagttgggatgacgcctatgcgctcatcgcgaaacacattaaggcgatggataatccggatcagatggagctttacacctcgggtcgcgccagtaatgaagcctcctggctttatcaactgtttggccgcatgtcaggcaccaataacttcccggactgctccaatatgtgtcacgaggccagcggtgctgggctgaaacgcagcatcggtgtgggtaaaggcaccattcgtcttgacgattttgatcatgccgatgccatttttgtctttgggcaaaacccaggcactaaccacccacgcatgttgcacagcctgcgtcacgcggccgatcatggtgctaaaatcgttacctttaacacgctacgtgagcgcggtctggagcgttttgccgatccgcaaaagccgctcgaaattgtgacctccaaagcgggcaccatcagctctgcctattatcaaccccatcttggcggtgatatggcggccgtgcgcggcatggtgaaagccctgctggaaacccatcgcgcgcgtattgcagcgggcgaaagcggcttgttcgatcaggccttcctgaacgccaaaacgcacggcgttgaggcgtacttcgacgccgtagataacacagactggatgcagattgtggcgcagtcgggcctgacagaagcacaaatccgcgaagcggcagcgatctatcagagcgccgatcgggtgatctgcacctgggcaatgggcattacgcagcacaagcattcggttgatacggtgcgtgaaatcaccaacctgcagctgctgtttggtcagttaggtaaaaaaggggccggcctctgtcctgtgcgtggtcacagtaacgttcagggcaaccgcaccatgggcattgatgaaaagccgtccaaacctttcctggatgcgcttggtcagcactttgactttgagcctccgcgtgcggcaggccataacaccgttgaagccctgaacgcgatgctgcgtgatgaaattaaggttcttatcgccctgggcggtaatctggccgccgcagcaccggattctccgcgaactgaagaagctttatctcgctgtggtctgactgtgcacatcagcaccaagctcaaccgtagccacctggtgccgggtcatgaagggttgatcctgccgacattgggtcgtaccgaacgcgatctgcaggcgacaggtaaccagttcattaccgtggaagattcgttcagcatggtgcatgcgtcagaaggtgtcggtattcctctggcggaaacacagcgttctgaaacgtcgattgttgccagtattgcccatgcggttctcggtgatgacaaggtgaagtggttagatctggcggctgattacaacctgattcgcaatcatattgcggcaaccattcccggttttgccgacttcaataccaaatgcgatcagcctggtggcttctatcttggcaatgccgcggcagagctgcgttttaatacgccgaccggtaaggccgagtttaacccggcagcgctgcccgagtcgctgtttccgaagcttgatcaggaagtgcctttcacgctgcaaaccctgcgctcgcatgaccagtacaacaccacgatttacggtctcgacgatcgttatcgcggcgtgtacggccagcgtgaagtcgtctttattaaccccgacgacatggctgagttagggtttagtgaaggccagaatgtggatattgaaaccctgtggaatgatggcatcacccgtcgcgtgagcggcttcaaactggtgccttacaacattccgcgtggcaatctggcggcctactatcctgaaactaacccgctggtcccgttaaacagctatggcgatatcagcggcacaccgacctcgaaatcggtgccggttaagctggaattgtcgcaggcgttgaccacccaacgtatcgcctgattcaggcttttctccaggcaaaaagccggttcgtccggctttttgccttgccgcgagaccccgattcgcgtaaaactgtcagccgctattaggccacgaaacgtaaaaatcatgttccaggataatccgctgcttgcgcagcttaaagagaagcttcattcgcaaacgccgcgtgcagaaggcgttgtaaaaggcaccgagaagggattcggctttctggaagtcgatgcacaaaaaagttatttcatcccgccgccgcagatgaaaaaagtgatgcatggcgaccgcattgttgccgtcatccacagcgataaagatcgtgaaagcgcagagccagaaacgttggttgagccttttctgggccgctttgttggccgcgtgcagaaaaaagacgaccgtctttctatcgtgcccgatcatccgctgctgaaagaggccattcagtgtcgtccggtgcgcggactgacccatgatttccagaatggcgactgggccgtcgctgaaatgcgtcgtcatccgttgaaaggcgaccgtggcttttatgccgaactcaccgaattcattgtcaaagccgacgaccccctcgccccgtggtgggtgacactgtcacgtcataatctggagcgtgaagcgccagaaatcggctttggcgacatgctggacgaaaacctgacgcgtgaagatctgaccgccctggatttcgtgactatcgacagcgccagcactgaagatatggacgatgcgctgtatgccgaagcactggacgatggcgcactgcgtctgaccatcgccattgccgatcccactgcctatgtcgcagaaggtagcgagctggataagctggcggcgcaacgtgcgtttacgaactatctgccgggctttaatatcccgatgctgccccgtgagctgtcagacgatgtctgctcgctgcgccctgacgtgcgtcgtccggttctggcgtgccgcgtgacggttgctcaggatggtagcctggctgacgatgttcagttctttgcagcctggatcgagtcaaaagccaaactggtttacgacgaggtttccgactggctggaaaacagtggcgaatggcaaccgcaaaacgaggctatcgctaaccagatccgcctgctgcatcgcttgtgtcagtcccgtgctgaatggcgtcaaaaccatgcgctggtgtttaaagatcgtcctgactaccgttttctgctgggcgaaaaaggggaagtgctggaaatcatcgccgaaccgcgtcgtattgcgaaccggattgttgaggaagccatgatcctggcaaacatctgtgccgccaatgtgctgcgcgaaaagctgggttttggtatctacaacgttcacgcgggtttcgatacggcgaatgccgagcaggccgccgctgtgctggcgactcacggcattaccgccgatccgcaggctatcaccacgctggaggggttccgcgtactgcgccgtgaactggatgcacagcctactcagttcctcgacagccgtattcgtcgtttccagacctatgcggagatcaccaccgaaccgggcccgcactttggcctggggctggacgcttacgccacctggacctccccaatccgtaagtttggcgacatgatcaaccatcgtctgctgaaggccatcgtgcgcggtgagcaaatcggtcgtccggatgatgcgctgacggtcaccatgagtgaacgtcgtcgtcttaaccgcatggcggagcgtgacgtgggcgactggctctatgcccgttacctgtcgccctttgcggctacggatcgtaagttcagcgcggaaatcatcgatgtttctcgtggtggcatgcgcgtccgcctgctggaaaatggtgccgtggcgttcattccagcgccgttcctgcatgccgtgcgtgacgaactggtttgcagccaggaaagcggtacagtacagattaaaggtgatgtggtttaccgcgtatccgacgtgattgacgtgaccattgctgaagtccgcatggaaacgcgcagcgtcgttgcacgccccgcagcctgagactaaaccggtgggacagccttgtctgtcccgccgacacattccacctcgccttccctctgcatgtgcgtgctaaatttgctccgcgcttcacagttttatctttattaacttccacttacattccattacattaacgttagctcgttgtcttcgatcgccttccattcggtctctacaaggagtgagttatgaagaacgtcaaaaacggcgtgctttggttagcagtggcgttaattggcgcgggtgcgttcgcgatgctggcgcttaaccgcggcgagcacgtcaacgcagtctggctggtggttgccgcagttgccttttacagcatcgcttatcgtttttacagcctgtttatcgcccgcaatatttttgaactggacgaccgccgtctgacgccagctgagcgcctcagcgatggtcttgactatgttcccaccaataagtgggtgctgtttggtcaccactttgcggctatcgccggtgctggcccgctggtcggcccgattctggcggcacagatgggttttctgcctggcactatctggattctgatcggggtgatgatggcgggcgccgttcaggatttcctgattctgtttatctctacgcgacgtgatggccgttcgttaggcgaaatggcgcgtcaggagctgggcgcttttgccggtgtgattactatgctgggtgcgctgggcgtgatgatcattattctctctgcgctggcgctggtggtggtgaaagccctggccaacagtccgtgggggctgtttaccatcgcggcgaccattccgattgcgctgtttatgggcatctatatgcgctttctgcgcccgggtaaaatcgccgaagtctcgttgatcggctttgtgctgatgatggcggccattatttacggtggtgatgtcgcacagcatccttactggggcccgttctttacgctgaaaggcacctcgctgacctgggtgctggtcatctatggttttatcgcctcagtgctaccggtctggctgctgctggccccgagggattacctttctacctttctgaaaatcggcgtcattgtcgggctggctgtgggcatcatctttgccatgccagaaatgaaaatgcctgccgtgacccgatttattgacggctcggggccggtcttctctggcgccctgttcccgttcctgtttatcaccattgcctgtggcgctatctccggcttccatgcgctggtatccagcggaaccacacctaagctgattgagcgcgaaagccatattcgctttattgggtacggtgccatgctgatggagtcgttcgtggccatcatggcgctgatttgcgcctcggtactggacccgggtgtgtactttgcgatgaactcgcccgcggcactgattggtaccacggtagaaaatgcctctcaggtcatcaatggttggggatttgtggtcacgcctgagatgttaagcggtatcgcccgggatgtgggcgaagcctccatcctgtcacgtgccgggggtgcgccgacctttgcagtcggcatggcacatatcattactgaggtgtttaacagccgcgccatgatggccttctggtaccacttcgccatcttatttgaagccctgtttattttgaccgccgtggatgccggtacccgcgcctgccgctttatggtgcaggatctggttggcacggtcgtgccgtctatggcgaacaaccgttcatggctgggcaatatgtcagggaccaccgtcgccgtcgccggctggggtttcttcgtttatcagggcgttatcgatccactgggcggtatcaacaccttgtggccactgtttgggattggtaaccagatgctggcctctatggcgctgatcctgggcacggtggtgctgttcaagatgaaaaagcagcgctatgcatgggtgacgattctgcccacgatctggctgtttattacctcgatgacagcgggatggcaaaagatttttcacgaaaaaccgtcaattggtttccttgctcaagccaataaattccgaaaaggtctggatgaaggcgttatcatcgcgccagctaaaaccgtggccgatatgcaaaccatcgtattcagtaaccagattaatgctgccctgtgcgggttctttatgctggttgccgtcacgatgctgattgccgccttctttgtgattcgccgtgcgctaagcagcaacgtgcctaccacgcatgagtcagatgtggaattgcgtaaggaggtgcgccatgtatgacagcatccatcgcgtagcgcgcccccagggtagctggcatattatgcgttgcgatttactttccacccctgttcgcaccggctttcgctggcgtgcactgtggcagggacttcagcaaagttttcgtttgatggttggcgtgcaggattatcaaaaatacctgcagcacatgcggcggcggcatcctgaaatgacaccgatgagcgagcgggagtttcatcgttattgtctggatgcccgctttcccagtcaggccggaaagctgggtaaatgtccgtgctgaacataaactgagccccgcttcggcggggttttttatgcccgttttttctggaaagtaaaataaatacagtttcatcttgtgctggcatcagttgatgaatactgttgctaaaataacgagataacgccagcaatgtacttcctggagggagtgaccatgaccgatgaacaagggcaatcattgttgtataccttgtttggtacaaccagccctcattggcgattaaacgcggacagtgatgcgctgctatttgccttagatgaatcatcgaacaccagcgtggctgttcccctgacgccgggtcaatgcagtttgcttcgcgcgatgccggttatcacttccagtataaatctgacgttaacaatacacggcgagcaggtcgccatgcattttgttggtcgcaggatcaataaatccgtctgggccggtaccgcgtcggcatggggtgatacctcggccgtggctcgcgacctgacgctgggtctgtcttttgctgaacaggtcgtttcggaagccaattccgtcattgtgatcctggaccagcgcggcaacattcaacgctttaaccgactcagtgaagagtacaccggcctgtatgaacaggacgtgatcggtcggaatgtttttcagctgtttatgaccaaacaggaagctgccgcctcacgtcgtaacattgcgggtttcttccgcgacggtaactcctatgaagtcgaacgctggatcaaaacgatgaagggacagcgactgtttctgtttcgtaataagtttgttcacagcggcagcggtaaaaatgaaattttcctcatctgttcaggaacggatatcacggaagaacgccgcgcgcaggaacgactgcgcgttatggccaataccgatggtattactggcctgcccaatcgtcatgcgattcatcagcagattagccaggcgctggagcgtgcagaaggcagcgaaaccggcgtggtctatctggatttagataactttaagaaagttaatgatgcctacggtcatatgtttggcgatcagctgttacaggccgtttctctggctatcctgagctgtctgagcaaaaaccagacactcgggcggctgggcggtgatgaatttgtcgtgctggcggaacacaccagccaggcggcgctggaggcaatggccacgcgtattctcgatcgcctgcgtcagccgtttcgcattggcctgatcgaagtttacagcggctgttcagtcggcatcgcccttgccccgctgcatggggaagatcgtgaatgtctgattcgtaacgccgatacggcgatgtatcacgccaaagagaataaccgcggtcgatattgtgtttttgctgaagagatgaaccggcgggtttttgaatacctttggctcgataccaatttgcgtaaagcgctggagcaggaccatctattagtgcattaccagcccaaagtcgattctgacggtaaagtacgcagtgcggaagcgctggtccgctggaattcgccagagcgcgggctggtatcacccggcgaatttatcccctatgcggaagagtccggcctgatcgtgccgcttggtcgctgggtcatgctcaatgtgttgaagcagattcttgcctggcggcagcagaatattcacctgcgcgtcgcggtgaacgtctcggcgcgtcagttgctcgatcaatcgatctacagtgacctgaagcaagccctgacggatgcgggtttgaccgagtccccagtagatattgaactgacggaaagctgcctgatagagaatgaagccgaagcgttgaagctgatgcgtaaattccaggaactgggcgcgcagattcaccttgatgactttggcaccggctactcctccctgtcgcagctggcgcgcgtgcccattaatgccattaagctggatcaaagctttatccgaaatgtgaacaaacggccagtatcgcagtctctcgtcagggccattgtcgcggtggcgaaagcgctggatttgcaggtgatcgccgaaggcattgaaactgtcgatgaagaagagtttgtcgtgaaaagcggcgtcgatgggcgacaaggctatttttacgcaaaaccaatgcccgcagaacagtttgggcactggctggctcagcatcctgcccgcgtctagatcgctaacccgctttacgcagtgatgcgctgtggcggttttgtaactgtactaaacgttccatataggcaatatctttcgcttcgagcgtaaatgcgtaatctacccagtcctcggtaatatccattaattcagcgcgtgacagctgtaatacccgctggcgcgcctttaacatggcacgaacgccattgagttttggccgcaatgtatcgataaacgtgcgggtagcccggtaactgtcgcccggttgaaataccttatccactaagccgcgcgtttcgtaccattcagcactgtgggactcaccttccatgatcagctcttcagccagtttcatgcccgaacgccgcgccactaacgagtagcctcccattcccggaaacaggttaaaggcgatttcaggaaagcccatccgggcattgttctgggccaggataaagtgatgtgccagcgcggcttcaaaaccgccgccaagggcactgccttcaatcatcgcgagcgtaaccgcgccggtatcaaatccgcgggcggccgagtggatgcagtcaacacaagcccgtgcataggcacgcaaagcttcacggcggttattgcgaatacattccacaaaaaagcgcagatcgccaccggcattgaacatttgtggtactaacgagcctgttacccagaaatcgataggtaagcccgaacgctgagcggtataactcaggttcatgatttcttcgatcaattcatgattaaaactggggcgtggttgggcgcgcaacatcatccacatggtgcgacgtccttcctcgtaataggcaactaactgcgtagtgtgtccggcttcggaaaacagtctgcatgtgggttggttaatcacggtcattgtctcatcctctgttattttgatgcgctaattgcgccacatcagcctaatccagagtgaggccagaccaaatgagagattgatttacaacataaattccagagtgatccccgatgcattcggtttaaatgattagtatgctttcttgataaagtcaggctaaatcgcagaaagacgcgaacctataacgggtattgatgagactgaaaaccgcttaacatgccgccagcaataaacgggtcaggacgcagacaaggctgcgcccccataattatttctggccgtaccaggcattttcaccgtgcttacgcagataatgcagatcaagcagggtttgctgaataggcggaagaccggcagtgagttgctggctaaacaatcccatgtaggccacctcttccagcaccaccgcactgtgcaccgccgcatgtgcgtctttgccccaggcaaaaggaccatgcgagtttaccagcaccgctgggatggcggtcggggaaagcccgcgttgtgcgaaggtttcaataatcacctcacctgtattccactcatactggttcttgatctcttcgtcacgcattgctcgcgtgcagggaatttcaccgtagaaatcatccgcgtgcgtggtgccccaggcaggaatcgggcggcctgcctgtgcccagatggtagcgtggcgggaatgtgtatggacaattccgccaacctcgggccaggccagatatagcgcccggtgcgttgcggtgtcggatgaagggcgtttctcaccttcaaccacctcaccggtggccagattcaccactaccatgtcctcaactttcatcacatcgtagctgacgccggaaggtttaatcactaacaggccttgctcacggtcaatggcgctgacgtttccccatgtaaaggtgacaaggttatatttggggagatccaggttagcttccagaacctgttgtttaagatgttccagcatttttttctcctgctgagaagggtcttaatattctgctgagcaggcaggaaaagcgttatggagcaaatggctaaaaagcagcggaaaatggctgtgaatgaaaaattgtgctgcgaattaagaattatctatcttcggaaattcttcaaaatgaatagaattctgtcaggcatccgacagatccacctgtcgatgatgcttttcagccgctacaaacagatcttccatggtgtctggcgtttttataccaaaagggatgcggtaataatgcgacacaggcggcctgaaaaaatttcacagctatacttactgtgttgcctctgcatacacaataaaggagaagtttatgacaattacaatgaaaaaaatgaccgctgttgtattagcaaccacgctggttatggcgttaagtggctgttcaaactggtctaagcgtgaccgtaacaccgcaatcggtgcaggtgccggtgcaattgggggttctgtattaaccaacggcagcgcgctgggtaccgtcggcggtgcagcagtgggtggtatcatcggtcatcaggttcactaagaaccgcattacaataaataataacggctacgcagcgcatctacataacaagccgggctactttgtagcccggtttttttatccacccgccagtttgaccttcatccctttggcttccagcaggctttttaataagtcacgtttgtcgccctgaatttcaatcacaccctcttttaccgcgccgccgcaaccgcattttttcttcagttcagcggccagctgattcaacgctgattcatccatatccacgccggtaataaggcaaacgcccttgccttttcgtccgctggtttggcgctggatacggacaattccgtcacctttaggacgttctgcctttggctcggactgagtaaggcgacctgcgtccgtagaatagactaaagggttatcacggctcattttaccgtctccaaatcctgcagtagcgcctttagcgtcgctgcggggtccgcggactgagtaacaggacgtcctattaccatataatccacgccagcaagccgggcctgctgcggcgtcatgacgcgacgttgatcccctgcgtcactacccaggggcctgattcctggcgtaaccagcgtgaaatcatgaccgataacctgtttgaaccgcgcggcttcctgtgccgaacagaccacgccatcaagtccgcattcgtgcgtcagttttgccagtcgctcagcctgctctgcgggtgacacggtgatcccaaggcccaataagtcatcggcatccatgctggtcaggacggtaacggcaatcagcaaaggcgcctgctgaccaaatggcagcagcgcttcacgggcggcattcatcatacgtgccccgccgctcgcgtgaacattcaccatccagacaccgagatcggcagcggcggcaaccgcacgagcggtggtattggggatatcgtgaaatttcaggtcgagaaagatgtcgaatccacgctgctgcagggttttcacaagttgcgggccaaacaaggtgaacatttctttgcccaccttcaggcggcaactgcccggctctatctgatcgacaaagtgcagcgcgctattcatatcgtggtaatcaagcgccactaccaccggcgaagtctgggataaggccatgctatttcctctgcagtaggcacctgctggcgcgttagacaaacggcacgcattctacctgcctgcttttcgcatcacaatccctgttgttctgctaagcgatatgcgcacggagctggactgttattttgaataaacgccaatagtatgttgtaactaaaaaaagcgaccgacgccagcgcttcggggctattgtccatcgagtccgcgaatcggtttaacggatgaccaggtccggcatgaaggacagtgccagtaaagcgcatgcgccgtgaagccgcatttgtggcagcgatagcgtggcttggtgcggatttgttcgccaaccagatcgcgcagcaccatcaggctttcttttgcacgcccatcttctgcctcgtgcaggtgaaactccatcaggcgatgaaagacgcgcatattggggtgacgttgtaactgatgattaatgtaattttgcgcggcttcggcgccctgctgccgctccagaatctctgaaagataaagctccgctgcagcacctgtattctcgtcaacacaacgcttaaggaattctgcccaggcatcaggctggttgaggcgctgaaaacacgtctccagcatcggtagggtttcactgacgagctctttatcctgatccagaacgcgctgcaaatgctcgacggcttttgcgtactcccctttttccatcaggatacggcccatcataatagagacgcgagcgctctgccgatcggccgactccccctttttcagcagcgtcatggctctgtcgaggtcgtcgctgctcatcgcctgcagggcgagttcacaataaaagtgggcaatctcacctttctgccggtctttacccagctttaccaaccgctcggcgacgtcaatagcctgctgccagtcgctggtcgcctgatggataagcagaagttgttgcagtgcgccaatacgaaaatccgtctcatccgtcagctgtttgaacatgtcttcggcacggtcgtaaaggcctgccgccatgtagtcccgccccagttgctgaatcgctaacaggcgctgttcgtagcttagtgacgcgctttccattaaggactgatggatgcggatagcgcgatcaacctcgccccgggaacgaaacaaattgccaagcgtaaggtgggcttcaacggtgccgctgtcttccttgagcatatcaaggaacaggtcgaccgctttatcttgttgattggagagtaagaagtttacccccgccacgtaatcacgcgacaggcggtttgattcctgttgcttgtcctgctgcgcactgcgtctgcccatgtaccatccataggcagcggcgacaggaagtaacagaaacagcagctctaacatggaggcttattcctgcacagccggcggcagcggtttaccacttgtgcctggcgtgctctgatcgacctgcgcctgcagacgcttaattttacgctgcgcattggcaagagagacgcgaatacgtaaccagaagagcccacagataacccatcccagcaaaaagccaacaccaaaaagggttgccagtaaggtggagatacggaagtcgccctgcgccagcagatagttaaaggtgataacctggtcgttgtgcgcgccaagggtcacggaaatgataaaaatgaccaaaaccactaaaaaaatcagcaaatatttcacagtgcatcccgttgtgaggtagtcgaaaagaattatgccaaaattacggcaaaaatactgctcctggcagcatcagatgacgcgcttttgctcaatctcaagataaagatatggtgctgaatgttgcaattacaatccttggtcccgttcagcgacctcttgctgttcttctggcggcaagctcagtgggccacagaagcgttgggcgagccaggtcgccaggacaaccaacagccaggaaatgaaagtggcaacggccagatcgcgcggccagtgcatacccagcagcaagcgactgcccattacggccacggcccagacgccgacaagcacgatggttttataatgccgacgcggccataacaaaccgatgaccagcaaggcccaactggcggcaaacatggtatgtccggatgggaaagcaaaacccgtttcaaatgcccagtgttttttcagccagccgggaatgtgcgactcatccgcgatcagctcggtgacgcgctggccacgttgctcgcggctcaactggtaaaaggtcttatcatccagcccgtgggttttctccagccagacaacataagggcgcggttcctgcacccgctctttgataaaggatttcgtgtactggccggctaaaatcgtagcgttcatgatcaacagcagcagtagcgccggtttaagcctgaaacgcaggcaccacatcacccaggcacttaacaccaggctggtcagcatgccccagggccgcgtgaccgtttccgtcatccagaacaagatcttaagaaacgtattactttcgccaggctgccactgccaaccggacaagccgaccgcaacaggcataatgagcagcagcaccattccggccagcgtacgttgaaagatgttaaccatcccttttcctttctcctggtgaaaacctataacaaaagcataactttagcttaaaaaagaataacataaccttttcagattagataatcgtgctttatcacaacaatcgtttacacagattaacagcctgcctcgcggttgtggcacaatattcctcgtttgtcaggccgcatcggcctgtgcactattatgatgatagtgcatcctttgagggttctggagagtcacatgcagcttaaacgggtggcagaagccaaactgccaacgccatggggagatttcctgatggtaggttttgaagaactggcaaccggtcatgaccacgttgctctggtctttggcgatattaatgataatcaaccagtgctggctcgcgtccattccgagtgtctgactggcgatgcgctgttcagtttgcgttgcgattgtggcttccagcttgaagctgcgctgaatgccattgcggaagaaggccgtggtgcactgctttatcaccgccaggaaggtcgcaacattggcctgctgaataaaattcgtgcctatgctttacaggataagggatacgacaccgttgaagccaatcatcagttgggttttgccgctgacgagcgtgacttcaccctgtgcgcggatatgttcaagttactcggcgtgaatgaagttcgtctgctgactaacaatccgcgcaaagtcgagattctcagcgaagccgggattaacattgttgagcgcgtgccgctggtggtggggcgcaatcctgaaaatgcgcactatcttgatactaaagcagaaaaaatgggccatctgttgcctaagtcctgaatgaaacagccgggtcgccccggctgtcttattagttaagcatgttgcgaatgacgtagtgcaggatgccatcgttgcggtaataggtcagctcattaccggtatcaatgcggcagcgcgtgtccagcgtctctttactgccatcagctcgcgttaacgtaaccgaaacggtacatcccggcttaagctgagacagattttcaacgtccaccgactcatcccccttcagacccagggttttacgcgtgacaccctgtgggaattccagcggtaaaatgcccataccaatcaggttggaacggtgaatacgctcaaaagattcggcgataaccacgcgaacgccttgcagacgcggccctttcgcggcccagtcacggctggaacccgacccgtactctttccccgcaatcactgccaaaggtacgccctcagcctgatatttcatcgcagcatcgtaaatggccagttgttcaccgctgggatagtgtttggtatagccaccttcaacgccaggcaccatttcatttcgaatacggatgttggcaaacgtaccgcgcatcatcacttcgtggttgccgcgacgtgaaccataggagttaaaatcattgcgctcaacgccatgcgacagcagataacgacccgccggactttcggctttaatgctaccggcaggcgaaatgtggtcggtggtaaccgagtcgccaaggatcgccagcaggcgcgcgccatgaatatctttaaccggtttaggttctttctccatgtcatcaaagaaaggtgacagacgaatataggtggaaccttcatcccagtcataggttgccgcttcactcaccttgattgcctgccactctggcgtgccgtcaaagacctccgcgtactccttatgatacatatcgctggtcacctgctgtacggcggtcgcaatctcttcaggtgacggccagatatctttcaggaagactggcttgccatcacgatcctgtccaagcggttcggtttgcaggttgatcttcatattacctgccagcgcataggcgaccaccagcggtggagaggccagccagttggttttaatcaacggatgaattcgcccttcaaagttgcggttgcccgacagcaccgcccccaccgtcaggtcgccttctttaatcgcagactcaatttcatccggcaacggacccgagttaccaatacaggtggtacagccgtagcccaccaggttgaaacccagtttatcaaggtgcggcgtaagctgcgcgacggccagatagtcggacaccactttggagcccggtgccagggacgctttcacccacggctgacgttttaaaccacgctctaccgcttttttcgccagtaagcctgcggccatcaggacgctggggttagaggtattggtacaggaggtgatcgccgcaatagctactgcgccatcggtcagcgtatgcgtcagcccggttgcactgtcggtgtactcaacctgcttatgtggtttttgtgcgtgattgacttcaagttcattactggcgtcaaaagcggcaggcacatcgcccagcgacacacgatcctgtgggcgcttaggaccggcaaggcttgactctacctgattcatatccagcgcaaggctgctggtgaaaataggctcgtcgccagcgtttcgccacaggccctgacgtttagcatagtgttcgactaacgccacctgctccgcatcgcggccggttaacgtcatatagctcagcgtcacttcatcaaccgggaagaatccgcaggtcgcgccatattctggtgccatgttagcaatggtcgcgcggtcagccagcggcaggtcagccagaccatcgccatagaactcgacgaacttgccgacgacgccatgtttacgcaacatttgcgtaacggtcagcaccaggtcggtcgcggtaataccggcgcgcagtttaccggtgagtttgaaaccgaccacgtcgggaatcagcatggagacgggctgccccagcatggcggcttccgcctctatcccgcccacgccccatcccagtacgccaagggcattaatcatcgtggtatgagaatcagtgccgactaacgtatcgggccaggcatagttttcgccgttaattttttgttgccagatagctttacccaggtattccagattcacctggtgacagataccggtacctggcggtacgacccgaaactggtcaaaggccttttggccccagcgcagaaaaacgtaacgttcgtggttacgttccatttccaggcgcacgttctcttcaaaagcctcatcgtcgccaaaatggtccactgttaccgagtggtcgattaccagatcgacaggtgaaagtggattcactttcgccacgtcaccaccgaggcgattaaccgcttcgcgcatggcggccagatcgaccaccgccggcacaccggtgaagtcctgcattaatacacgtgccggacggtaggcaatctcgcgatcggcatgggctgttttctgccagtcgacgagagcctggatatcctctgccgtaacagagtcaccatcctgccaacgtaacaagttttcgagcaggactttcatggacttgggcaagcggtcaatgttgcccagatgttgtgatgcgcgaggtagactgaagatgtgatagttttgattatctacctgcagtgtttcctgactctgctcgcgtagtgttaacgacatagctcctcctttataatcatggtctttaaacctcagagacaacaaggtttagtataaagatagaccacttttctgttaacgttttgattacaacaccaattgctacaatctgacgcaaacaaaaatgcctcgtaaaattacgaggcattttttataaaccggaatcgttatattacagggcagcccaaaacgcggtcatccacacggtaaaggagaaagcataggcactgaaccaggtcattttaatcatattcataagattactcctgcgccgaatgggcaataaaaagccgtacaaccatcctttttaagggatgtcatcttttatactgcgtgtgaaaagggcttaattaagcagcctgaatgacagaagatgtgtctaaaagaaaagagcgatgtttaattattttgctttcgggtccagaaaagactcgatgaaattacgttgatgatcatttaaatcccagttctcggggatagacactttttccgcctttgcaaccggctcttttgctttgtagccagagagacggtgctgacgagtggtggtcgtgtgcttatggcagagtgcgtttgcccacatggcttaaccccaaatgcgccaaatcattaatgctacaacaacccagaacagcgctgaggcagcgaatacagtcaaccaggcgttgcgacgagtgttacctgagcgcttaaccttggtgcttttaaccgggaaacccgggtctacagtcagtctcgtagtcatagtttttgataatcactctcaacaaaacgattgataacatcgattaagatttaggaagaatcctaaacccgttaaggccaaaaatccagtaatttttattgcacaaaacgattaacgcaatttatcaaaacggttaaaattacttaagtaacgattaattacttattattaataaacctgaatcgcggtcacaaaaatttgagttaatttaactttagatccagccataactaaactcctctttctgcagcccctgaataaacgctttaccgtcaaggcttaactggagtatgggaattatcctggcgagtcgcaaagatatcacgtcaaaaatgtgtcgtaattcgcatttaagatacagcaaactttaaacatgtgatcgacacagcattaacaaaaaaataataaaacttttcaacctaagcatggcgctaacgttcaaacaaaaaaaaggctgcactaagcagcctgagactaatggattgcacctaccggttacttaaacggcagctttatatccttaaacatggcttcaatatcgtcgttagaacgcagcgccaccgccgtatccaccacatcgcgcgtcagatgcggcgcaaagcgctggataaagtcatacatgtaactacgcaggaaggtgctgcggcgaaatccaatcttggtggtgctgttgatgaagatttcagaggcttcaattctgaccagatcaggatcagcgacagggtccactgccatactggcgataacgccgactcctaatcccagccggacgtaagtttttatcacgtccgcatctgtcgcggtaaagacgatacgcggcgtcaggcccgcgcgcataaaggcggtatccagctctgagcgtccggtaaaaccaaaggtgtaagtgaccagcggaaaatcggccagttcctcaatggtcacctgccctttgcctgccaggggatgatcgggcgtgacgacaatagcccggttccagtgatagcacggcagcatgatcaagtcgtcgtacaggtgcagcgcttctgtggcaatcgcaaaatcggcattaccctttgaaactgcctcggcaatttgcgtcggtgatccctgatgcatatgcagtgagacgcgcggatagcgctcgataaaccctttaatcacgccgggcagtgcataacgtgcctgcgtatgggtggttgccacatacagcgagcctttatcgggccaggtatgttcaccggccacggacttaatcgcatccactttagagagcacttcacgggcgatacgaattatttcttcacccgccggcgtcacctgggtgagatgcttaccgctgcgggcaaaaatttgtacgccaagttcatcttccagcatacgcacctgtttactgatcccaggctgcgaggtgtagagaccttctgctgtcgacgagacattaagattgtggttaacgacttcaacgatgtagcgcaactgctgtaatttcatatctgtttttatcctggtcggttacagagtcgcatccccggctgacgtactgtcgcccaggcgggtgaagtatggctgagcagtaagaagggatcggaaatgctataaccactatagcattttaagtaccactgtagaacggattgatataaggcaagaaaaaggccagcgggcgctggcctttaggggaattactttttcgcttcctgccacttgccgtcaatatagaaggctgaccatcctgtggctttgccttctttttcggaagcaacatactgctgtttggttttgcggctaaaacggaccagggttttattcccttccggatcggtcgctggcgcttcagcaaggtatttcaacttctcaggcaggcgatcgtggaaacgttgcagttcctcaaccaagggtgcccgggtttcgcgtgattttggaaacgtgttggcggccaggaagacacctgcagcgccatcacgcagcacgaaataggcatccgacttctcgcacggcagttcaggcaagggtaccggatcttctttcggcggcgcgacgtcaccattgcgtaatatcttgcgcgtgtttttgcactcatcattggtacaagccatgtatttaccaaaacgccccatcttcaggtgcatttcagaaccacacttttcacactcaacaatgggaccgtcataacctttgattcggaactcgccttcttcgatttcatagccatcgcattcagggttgttaccacaaacgtgcagtttgcgtccgttatcaatcaggtagctgtccatggccgtaccgcatttctcgcaacggcgacgtgcacgtaacgcattggtttcagcatcatcgccttccagaatattcaggacttcattttcaggaatcagattgatggtttgcttacagcgctctttcggcggcagtgcataacctgagcaaccaaggaaaaccccggtgctggcagtgcgaatgcccattttgcggccacaggttgggcagtcgatggtcgttaataccatctggttaggctgcatcccaccttcttcgggatctttttccgcctgttccagctgctgactgaagtcagagaagaagcgatcgagcaccgctttccattccgcctgattgttagcgacctcatcgaggctgctttccatatgcgcggtaaaatcgtaattcatcagctcgcggaagttttcttccagacgatcggtgacgatttcacccattttctcagcataaaaacggcggttctcagacctgacatagccgcgatcctgaatggtggagataatggcagcataggttgacggacgaccaataccgcgcttttccagttcacgcaccagggaagcttcactgaagcgcgccggtggtttggtaaagtgctggcttggcaacaacgcctgcagactcagttcatcacccacgttaaccggcggtaatgtgcgatcttcatcgttcttacgcagtgccggcataactttggtccagccatcgaaacgcagcgtacgccctttcgctttgagtttgtaatcgcccgcggctaccgtcagcgtggtcgaatcatactgtgcaggcgtcatctggcaggcaacaaactgacgccagatgagctgatacagcttctgtgcatccgcttccatgtctttaagttgatcggccaccacctctacatcagaaggacgaatcgcttcgtgcgcttcctgtgaattctctttactggcaaaggtattggcattgtccggcagatattttttaccgaaattgccgtcgatatagccgcgaaccatggaaaccgcatcctgactcaggttggtcgagtcagtacgcatataggtaatgtggcccgcttcatagagtcgctgtgccatcatcatggttttttttacgccgaagcccaggcgcgtactggcggcctgctgcagcgtggaggtgataaaaggtgcgccaggcttgctgctggttggcttatcttcacgatcggtaacctcaaaacgcgctttttcaagcagcgccagtgcggcatgtgtctgttcgtgattgaccggacggaagggtttatcacccgcgtgggtgacctccatcgccaggtcgtcgcccttcggtgtggtcaggttggcgttgagttcccagtactcttcaggaacgaaggctttgatctcgcgctcgcgctcgaccactaatcgcacggcaaccgactgaacgcgaccggccgataagccacgggcgacttttttccacaacaaaggggaaaccatataacccacaacacggtccataaagcgacgggcctgttgcgcattcacacggtcaatattcagctcgcccggcgtttcaaaggcctgacgaatcgcgtttttggtgatctcattaaacaccacgcggctaaagcgtttgtcatcgccaccgatcacttcccgcaggtgccaggcaatggcttccccttcgcggtcaaggtccgttgcgagatagatgtggtcagcgttctcggctaaagcctttagttcagcaaccactttctctttatttggcagaatctgatagtccgcttcccagccgtgatagggatcgacgcccatacgactgaccagtgcggccttctcgtccttctttacttttttgacttttttatctgtcgaggtttcagcactttttttggcggttgaaccactggtcggcagatcccggatatggcccacgctggatttcaccacgtagccactgccgaggtatttattgattgttttggcctttgccggggactcaacaataacgagtgctttacccatatttacctttacctaatgaatacgtcctgctctacgggagaggattggatgcccaaaaacccatgaagttcacttttgctacgcctgtttttcatttcaggtcgtggggctcaatctctggtcagtgaaaacagctcatgcaacgttatgataaaaatcgctttttctccctgacttaatcgcacttcccggtgcaatatccctggaatctgaaacgcccacactgtacctgataaaatctgttacgcaacttaattagcatctgctgtgagtaaagccgcttttttacccctcacggcggtttgtcgaacaacgcggtacgcaagtaatatagaaagaattaacagactgtcaaaaaggagccgacacatgcacaatcagacccagggtatttcatctcaggcaatactggagatcgccaatacgctgcttgtacaacatgatgattatctcgccgacatcaaagccgatgcggtcagtcaacagggtgatgtcctcgttttccgtggcccctattttttggatgcgcaaggactgccaacggcaaaaaccactgccgtctttaatctttttaaacacctcgcggttgaactgtcgccccgctaccacctgatataaaaaaacccggccttggccgggtttcccttataacagcggtttgtcaccgcgttgccaccacttcagcattaagcgttccaggacatgccccgcgctatgagtcaggcgatcaatccttgaacggcggcgcacatagttaaccccgagcacggtaaatttatccatatgctgaataataaggtcgtcactggtagagatacgatcgaccaggcccagcgtcagggcctggcgtccgtaccagtgctcaccggttgccaccttgtcaatatccagtgacgggcgcatttcatgcacgaactgcttaaacagcagatgcgtttcattcagatcctgctggaacttttcccgcccttcttccgtattttcaccaaacagcgtcagagtgcgtttatactgacccgccgtatgtagctcaacatcaatgtcgttacgcttaagcagacggttaaagttggggatttgcgccacgacgccaatcgagccgatgaccgcaaaaggggcggaaacgatctggctggcaacacaagccatcatgtatcctccgctggcggccactttgtcaacggcagcggtaaggtttaagccggcatcccgcaggcgttgcagttgcgacgccgccagaccataaccgtgtaccatgccaccagggctttccagccgcagtagcacttcatcacccggctgagcaacagcgagtaccgcagacacttcttcacgtaatgacttaacttcgctggcatcgatactgccattaaagtccagaacgtaaagcgtgggtttagtggtttcctggttgccctgcttcgctgcgcgtttctctgctttggccttttgtttttcggcctttttattgttttttaaccacagcttttgagcctgaggtttcattttctcaagctgcagctcttctttcattttggtgtagtcatcacccagtcgcgtcaggcggagttgcccactctgatgacgtttgcgctgtgcggcgttaacaacaatcattacgatagctgcaatggcaatcaccgccgtcaccgcttttgctaaaaacagtccataactcaaaagaagatccatcgtgtcgccttattaaacagaggattactgacaaacggttagtttaactggtttatccagacccgtcgcctgaaatgccagcacctggcacagaatgtacttattgccaattgcgtcatggcatgaattgaggcataaagcgtgaaaccctcacgttgcgggaggctcccaacatgcactatcaacctaaaaatgatctactcgcgaatcgcctgattcttgtcaccggtgcctctgacggcattggccgggaagcggccctgacctacgctcgctatggggctgaagtcatcttactgggccgtagcgcggaaaagctgcagcacaccaaagaggcgattggccagttgaatcagcgcccggcgcactcggtggtatttgatttgtctgatgcaacgccagagcagtgccatcaactggccgggcaactggcgcaacagttttcgcatctggatggcgtattacataacgccagcattttaggggaaatcatgccgctggcggaccttgatccgcaggtttggcaacaggtcatgaagattaacgttgatgcgacctttttccttacccaggccctgctaccgctgctgttgaaatcagaaagtggatcgctggtcttcaccacctccagcgtgggccgtaccggtcgtgcgggatggggcgcttatgcggtatcaaaatttgcgaccgaaggcatgatgcaggtgctggcagatgaatataaaaaccacgcgttacgcgtcaactgtatcaatcccggcggcacgcgcacaaaaatgcgtgccagtgcgtttccgcaagaagatgccagtaaacttaaaacgcctgccgatattatgccgctctacctctatttaatgggtgacgacagtcgccgtaaaaccggtatgagctttgatgctcagccaggcagaaaacccggagcagctgaataatgacggacgaacgccaccagcaacgtcagcaacgtttaaaggaacaggtggatgcccgcattgccgcagccagtgaagtcagaggtatcctgatggtatttaccggcaatggcaaaggcaaaaccaccgccgcttttggcaccgcgttacgcgcctgtggacatggcaagcgcgccgcggccatccagtttatcaagggtgagtggccaaatggcgagcgcaacatgctggaacagcacggtgttgagtttcaggtgatggctaccggttttacctgggagacacaaaatcgccagaccgataccgatgcctgccttgccgtctggcagcatgcgaagcgcatgctgtgtgatagcagcctggatctggtgattcttgatgaaatcacctacatggtcagtatggattatctgccccttgacgagctggtcactgccctaaaacagcgccctgctcagcaaagcgtgattattaccggccgtggttgccatcgcaccctgctggatatggctgataccgtcacggaaatgcggccagtgaaacatgcttttgacgccggtattcaggcccagcagggaatagactggtaaccttattacatgctattcagcaaaggtcagacgggatgcctgtctgacctgcatcttttcggcataaatctgtaaacctgatcgtcagcctgtcacccgatcgttacatgagcctcttgcccaataccgttaaaccctcgtccgtcgcacctcagaattccgcttgccgcgagcgcgctgttgggtcggtttcggcaaaaatgcgatctctgacgcgcctgtttactccaacctgccagccataaatgtaaattttcgattacgcttcacgcgccctttccagttccgttacctgaaattgaccgccatgatttacatcagtcattgatcacaatcacataatgcccggtgaacggccgcaaaaaccgatcgggatcactcttttatgttaaaaaaatgataaaaaaaatttagctttaatatcatctctttgtgcatggttaatcaaaacaagaggttaacccttaacacgctaagtaaatccataaattattatcttgttcgataacaattgaataacttttgccaatgagagggctgttattttgctgaccatactgggctttacgatggttgtttgtttcatgtatctgatcatgaccaaacgcatgtcagcgctgatagcgctaattcttattcccaccctgttcgctttgctgggtggtttctaccaggggctgggtgccatgatgctggatggggtgaaaaccctggcacctacaggcgtcatgctcaccttctcgattctctatttcggcctgatgattgatgctggcctgtttgatccactggtgcgttttattcttaaaatcgtgcggggcgatccgcttaaggtgctggtaggtacagcggtactgacgctgctggtctcactggatggtgacagctcaaccacctatatgattgctattgccgcgttccttcccctctaccgtaagctgggcatcaatgtgctggcgatgacctgtctggttaaccttgccagcggcatcatgaacctctctccctggggcggaccaacggcacgtgccgctgccgcgttgcgaattgacgcgctcgacattttcataccgatgttgcctgccatttttatcgcctgtgttgcccttgtgggcctggccttcatgtttggcttgcaggagcgtaaacgcctgggcgtgatgagcatcagcgaccatcatctggataatattgagttggggctgggtgatgctgaagagtgtgcagccaatcgtcggcctaaaatgttctggccaaactttgttctgactacggtgctgctggtcctgttggttgttggtgccatgcccattcagatcctgtttatgctggccttcgcgattgcggtgatgctgaactatccaacgctggaagaacaaaaggcccgtattggttcccatgccagtaatgtgctggccgtgacggcgctgattttcgctgcaggtatctttaccggtatcctttcgggaaccggtatggtggatgccatggcgaaaagcctgttggcctttattccacacagttttggcccctatctcgccgtgtttaccgccttaatcagtctgccttttaccttttttatgtctaacgatgccttctattttggcatcctgcctgtgattgcccaaacggctgccagctacggtatttccgcagaggaaattgcccgggcctccattgtgggtcagcctttccatttactgagcccgctggttccgtcggtctatcttctggtcggtctggcgaaggtggatatcggtgaccaccagcgttttgccattaagtggggaattttaatcagcctggtgctgatggccggtgggttaattacctgtgcgtttccgctgtttcaccggtaagccgttgtcacctgatcagtgagaaaacaaaaaagccgcaacgatgatcgttgcggcttttttaatgaatctgttctgaggtgcaaaccgatatcaggttgcgttacgcttactgccgggattacggcgggcaggtctgccactggtctgactgtggcgcttcacggcccgacggatctgattggccttggtgcggcgacggtctttctcgacagccagtttggtgacggtttcatcatccatccccaccatgttacgcagataattgaccgcagacagatcaagctccatccagccaccgcgtggaacgccttttggcaacgtgatatcgccataacgaacacgcatcagtcggctcacctggacgcccacggcttcccacaagcgacgaacttcacggttccgtccttcggtcagcgtcacgttgtaccactggttgataccttcaccaccggcaaagcgcagcgttttgaatgcggcggggccatcttcaagctgcacgcctttgctgagctgccgaattttgtcgtcatcaacctgaccaaatacgcgcaccgcatattcgcgttccacttcacggctgggatgcatcaggcggttagccagttcgccatctgtggtaaacagcatcaacccgcaggtattgacgtcaagacgacccacggcaatccagcgcgaaccgcgcaaccgtggcagtcgatcaaagaccgttggacgcccttccggatcgctgcgtgtgcagagttcaccttcaggtttgtaataggccagtacgcggcagacttccgttgcagattccgcaatagaaaccaaatgaccgtcaatacggatcttcagggctttgctgttttcgatgcgatcgccaagcgtggcaagcttaccgtcaacgctaacgcgtccggcagcgatcatcgtttcaatttcacgacgcgaaccgtgaccagcacgcgctaagactttttgtaacttttcgctcatggagctacctcattgtcgccttcccaggcgtcggatggattaggaatttaaccttaaaaatcaatgggttatattttcctgttggccccattatacaggatgtccctcgtaatgtaacccgtattatggcgttgccctgacacgcaccgcgggcaggcagctatcctgatggaatccaccttctgcagcgctggcgcgcattcgtctggcaacagaccctgccagatatcagcggcaggcataattataataatgaacgcgctgtacttaaagaatcgagattatcctcgccatcaacaggacatgttgtgaagcgcaaagcatcaggaaacgctttatagcttcacgtttcatcaattttacctgccttattgtggtgaaatggcgcactgatgaccgataaattgcctcaacagcaaaaagtaacgctttgttacttaattcaagttaatgtttcaccggcagcagttttagataattttaccgttaacccttcttagagaattcgcattaaaaagatttgtatttaatgatttctacgctataggtttatcgcgataacagtaaaagccgagtgaaattgtctaaagcagtgaaaatatattggtgagaaaattttatttttacaggcggaatgtcatttgagttaatttaaaaatgcagaaaaccacacttaagccaaatatttatttttttaatcatccgcagggtgggctttgcacattgaccgcactttaccgccgctttccgtcgcatctttacttgatatttcagagagtaacccacaacaaagttgtacaagaaaaaatatgttgtacaattttaattattgcgggatactgtgcgaaataatgccatctgaccgactcacttttggtcagacggctgtgtcgatattcgctctctcattacaataaatttacattaaaaaaaatggactggcggcaatctcagccgataaccattatacgacctttttagcagccctaatctaataagcatacagacgacgcaacgtttcaaacggcgctgtatgaaaaaaccgctaactggttgttattaaatatatatacaccggcgcatcaggaatatttgcgttaatatggctcttgatgagctttaatttgcatgtcttgaatcttcaccagggattttactgacatgctcacctgaagacaccactatgcaaaaacagtttgtgtgcgcagcgttattgacgctggctctgagcggttgttctgtgggccatactgagtacagccgtacggcgatgcagcacgttgatatgagcgtgacaggtatccctaccattcttggtttaggtacattaggcaccagcattcctttaacgccagactacagccttaccgccgctcacgtggcaaaatttgctgtgcagcgcgtgaagtcttatcacccttattgcgatctcgcgattatttatcataagaatccgccaaatacgctaacccaattccgcagcaccgatattggcgatgcggtaaaaatgtacggatacagctatatttcggcgctgcccgttgagtctaaaggggtaaatctggcgcgcacggcgatacgtaatacctggaataaaagcccgtgtattgccatggcctctaatgcgggagtcgtccagggcatgtccggcggcggcgtctataacagcgacgatacgttgggtggggttatcgtaggttactcagatgcaattaaaaatggccgtagcgggaaagtgattttaaaagatgtttcactttatatcccttacggccagtttaaaaactggttacaggcgacgattcccgtcacccgtaaaacctgagtgggttacagaaaaggtttcacatctcccacaccttcacggacgacttcaggtgcatcactggtgagatcaatgacggtggtgggctgctgtccaagcgtgccaccgtcgataatcagatcgacctgcttgccaatacgctgttgaatatcttccggatcagattccgtgaagtcattacccggcagaattaacgacgtcgacatcatgggttcgttcagcacctcaagcagggcaagtgctaccggattcgacggtacgcgtaatccaatcgttttacgcttttcattcatcaaacgacgcggcacttctttcgtcgccttaagaataaacgtgtaattacccggcgtgttatttttaagcagacggaaagcgctgttacccacctgagaataaacagacagttcagataaatcacgacacatcagcgtgaaattatgatgaccgtccagctgacgaatgcgacaaattcgctccatcgctcctttctcttccagccgacaacccagggcatagccggagtccgttgggtaaacaatcacgccgcctttattcaggtactctacggcctggttaatcaggcgcggttgtggattatctggatgaatatgaaacagttgactcatagaaacctcttatcccctttccgtacattccactgcgggtgccattgcgggaaaacgttcccagaccggttctaccgccgcaggtagccacaatttgcggcccagctcaatccacgggcagggttgatgaaaatcagaaccttgcgatgcagccagattgttatctctggcatattgcgctaactgcgtgcgctcagcgggtgcctgctgacattgtgcgacctcgatcgcatccccgccagcagcgctaaaactggcaatcaagcgctttagccatttagccgacaatccgtagcgtcccggatgtgccagcacggcacagccaccagaatggtgaatcgcatcaatggcttgattaattgtacaccattgcggtgggacgtagccggttttgccccgcgccagataatttttaaacacctgcgccatgttattcgctttgcccagatcgaccagatagcgggcaaaatggccgcgcgtaatcattcccccctcggctaagcgctgcgcccctgccagtgcgtcagggatctgcgctttatccagccgttcagcaatgcgctgcgcgcgctccagtcgcgccgcatactgacccgcaaggaactgggtcatcaccggatgctggatgtcgatgtttaacccgacaatatgaatttcatggttttcccacagcgttgaaatctcaacaccggctaaaatttttatgggcagttgctgattcagtacggcctgctgcgcctcagggatacccgcgacggtgtcgtgatcggtaattgccagcaccccaacgcgcatgtctactgcgcgctcaaccagtgcctgcggcgacaacaatccatcggaagcccgcgtgtgactatgaagatcgtaaagcggaaaacgggcgatatcgctcaaaacaactcctgctggctactgatcgggtcagcataataacgattttatcggccactgaaaaagtgtattgacatttttgtcacgaaccagttaactagtacacaagttcaccgcagacgggtatttgatcatgaaaactgtaattacgcttttaatgggttggtggcgcaatgtttcccagtacgggcgacgttgtcgtgcacaccttgcgtaaacactgtgcagatacctgagcccgcctccaagcgggcttttttttggacgatattcagagaaatcatcatgcttaatgcaaaaccgacagtgaagttaattaccggcagcgcgccctatcgggaagatcccgccgccgtttttcatcagttatgcggcgctcgcccggcgacactgctgcttgaatccgcagatatcgacagtaaagaaaacttaaaaagcctgatgattgttgacagcgccctgcgcatcagcgcattaggaaaccgcgtcactttacaggccttgtctgacaatggccgtgcgctgctgccgctgctggatgacgctctgccctctgaaatcatcaatgaacctcgccccgacgggcgtgttctgacatttacccctgtgcaggatcaccaggatgaagactcacgcttacgcgccctgtcggtgtttgacgcactgcgtctcattccacagttggtgaattccccaagcgaagagcgcgaagccgtgtttgtcggcggcctgtttgcctacgatctggtggcaggctttgaagatttaccagaactcagcagtgagcaacgctgtcccgactactgcttttacctggcggaaacgctgctggtgctggatcaccaggcgcgcagcgcacgtctgcaggccagcctgttctcgccttctacccacgaatttcaacgtctgcaacgccgcattgaacagttgcatggacagatgttacagcctgcaccggcgctgcccgttcagcctgtcgaaacgatgacgctgaccgtcagccagagcgatgaagagtattgcgcggtagtgcgtaagatgcaggaggccattcgcattggtgaaatcttccaggttgtgccatcacgccgcttttcgctgccctgtccttctgcgctcgccgcttatgatacgctgaaacgcagcaatccaagtccgtatatgttctttatgcaggatcaggatttttcactgtttggtgcctcgcccgaaagctcgttgaagtacgaggctgcgtctcgtcagattgaaatttaccccattgccggtacccgaccacgcggtcggcacgctgacggttcgctggatcgcgatctcgacagccgtatcgagttagaaatgcgcacagaccacaaagaactggccgagcacctgatgctcgtcgatctggcgcgcaatgatttagcccgtatctgccgtcccggaagtcgttatgttgccgacctgacgaaagttgaccgctattcctttgtgatgcatctggtctcgcgggttgtgggcacgctgcgcgatgacctggacgtgctacatgcctatcgcgcctgcatgaatatgggcaccctgagcggtgcgcctaaagtccgggcgatgcagctgattgctgacgcagaaggcacacgacgcgggatctacggtggcgctgtgggctatttcaccgccaacggtgatttagatacctgcatcgtaatccgctcagcttatgtagaagatggcgtagccaccgtgcaggccggagccggtgtggtgctggattcggaccctcaggctgaagcagatgaaagccgtaacaaagcccgcgcagtattgcgcgcgattgccactgctcaccactgcaaggagattttctgatggctgacatcctgctgctggataacatcgactcatttacctacaacctggtcgatcagcttcgtaccttcgggcacaacgtggtggtgtaccgtaataacatgccgacatcgctgttgatcgatcgactgcaaagcatgaataatccggtgctgatgctgtccccggggcccggcgcgccgaaagaggcgggctgtatgccagagctgctgcgcgcgatgcgcggaaagctgccgattatcggcatttgcctgggtcatcaggcgattgtggaaacctatggcggccatgtcggtcaggccggcgaaattctgcatggcaaagcctctgccattcgtcacgatggtgaagcgatgtttgccgggctcagcaatccccttcccgttgcccgttatcactcgctggttggcagtaatacgccggacgaattaacggtgaatgccagctacaacggcatggtcatggcggtccgccacgaaaaagatcgtgtgtgcggattccagttccatcccgaatccattttaaccactcagggcgcacgtctgcttgaacagacactggcctgggcgctggcgaagtaacagggagaacagtatgaatacgattctggaaaaactttaccagtcgcagatcctgactcaacacgagagtcatcaactgttcagcgccattattactggtcagcttgaaccgactcaactggcagcggttctgattgctatgaaggtgcgtggcgaaaaccccgaggaaatcgccggggcggccagcgccttactggaagatgccaaaccctttccacgcccggattacgcctttgccgatattgttggcaccggcggcgatggcagtaacagcattaacatctcgaccgccagcgcctttgtcgcagcaacctgcgggctgaaagtcgcgaaacacggcaaccgcagcgtatcaagcaaatcaggatcgtctgacctgctggctgcgttcggtatcaatctggatatgcctgccgagctggcccgtaaagcgctggacgatctgaatgtctgtttcctgtttgcaccgcagtaccacacgggttttcgccatgccatgccggtgcgccagcagttgaaaacccgcacggtatttaacgtgctcgggccgctgatcaatcctgcccgcccgccgctggccgtgattggggtttacagccctgaactggtgctgcccattgcgcaaaccctgaaagtgctgggctaccagcgcgcagcggtcgtgcatggtggcggaatggatgaggtggcgctacacgatgtcacccatgtggctgagttgcgtgaaggtgagattacccgctatcagctcggcccggaagatttcggctttggcttccatcctaaagaggctctggcaggcggcacaccggaagaaaaccgtgacattcttacacgtttactccagggtaatggcgagcaggcccatgaggaggcggttgccgtaaatgtggcgatgctgcttaaagtgtttggtaatgaagatctccgtgaaaatgcacagcgtgcgctcaatgccatccgtagtggtcaggcctatgagcgcgtggtggctctggcatcaagaggataatcatgcagggtacagtgttagataaaatcgtgaaagacaaagccatttgggttgaggcacgtaagcagcagcaacccctggagagtttccagcagcgcattacgctttccaaccgtagtttttatgacgcactgcagggcacccgcactgcctttattctggaatgcaaaaaagcctctccatccaaagggctgattcgtgatgattttgatcccgagatgatagccggggtttatcgccactatgcatctgcggtttccgtgttgaccgatgagaaatattttcagggtgacttcgcctttttacctgtcgtcagtgcggccataacgcagcctgtgctgtgcaaagactttattatcgatccttatcaaatctatctggcacgttactatcaggccgatgccatcctgctgatgctgtcagtggtggatgacgagcagtatcgtcagcttgctgcggttgcgcacagtctacagatgggcgtgctgaccgaagtcagtaacgaacaggagctggaacgcgccattgcgttggaagcgaaagtggtgggcattaataaccgcgatttacgtgacctgtcgattgatctgaatcggacacgcgaactggcaccccgtctgggccagggcatcaccgtcatcagcgagtcaggcattaacaactatcgtgatgtccgtgaattaagtcatttcgccaatggtttccttattggctctgcattaatggaagaagacgatcttcatgcggcagtgcgtcgtgtcaccctgggcagcaacaaagtctgtggtttgacccgtcctgaagatgcctgcgccgcctgtgatgcgggcgccctttttggtgggttaatctttgtcgagggttcgccgcgtcaggttgataccgataaagcgcgggctgttatcgcgggtgcgccgttgaagtatgtcggtgtgttccgcaacgcagcaataagtgacattgtcactaaagtgactgtgctacagctcagcgccgtgcagttacacggtgatgaagaccccgcctatgtagctgcgctttatcaggccttgcctgaacaggtgcaaatctggaaagcgctgagtattcaacatgccctgcctgagcgtaactggccccatgtggatcgttatgtttttgataatggcaacggcggctcgggccagacatttgactggtcactgcttcagggccaggacctcaagaatgtcatgctggcgggcggcctgagtgccgataactgcgtcgaagccgcgcagcttggatgtgcagggctggacttcaattcgggtgtggaaagcgagccaggtattaaagacgccagcaaaattgccgccgtattccggacgcttcgcgcctactgattgaccgggcccgtgttgtggcgggccacaaaaaaggatagcaaaacatgaccttactcaatccctattttggcgacttcggcggcatgtatgtgccgcaaattttgatgccagcgctaaaacagttagaagaagcctttgttagcgcgcagaaagatcctgaatttcaggctgaatttaccgacctgctgaaaaactatgcgggccgtcccacggcgttaaccctgtgcagcaacctggcaaaagggacaaaaacccgcctgtatctgaaacgcgaagatctgctgcacggcggtgcgcacaagactaaccaggttttaggacaggctctgctggcgaaacgcatgggcaagaatgagatcatcgccgaaaccggtgcaggtcaacatggcgttgcctctgcgctcgcctgtgcgttactgggcatgaaatgccgtatctatatgggtgctaaagacgtggagcgtcagtcgccgaacgtcttccgtatgcgcctgatgggtgccgaagtgattccggtacacagtggatcagccacgctgaaagatgcctgtaatgaagcgctacgtgactggtcaggcagctatgaaacctcgcactatatgctgggcaccgctgccggcccgcaccccttcccgacgattgtgcgcgaatttcagcgcatgattggtgaagagaccaaaaaacagattctggaaaaggaaggtcgcctaccggatgcgattatcgcctgtgttggcggcggttccaacgccatcggtatgtttgccgactttattgacgaagaaggtgtcaagctgattggcgttgagcctgcgggacacggtattgaaacgggtgaacacggtgcgccactgaagcatggtcgcgtcggcatttatttcggtatgaaatcaccgatgatgcagaccgatgaggggcagattgaggagtcgtactcaatttcagccgggcttgacttcccttctgttggcccacagcacgcccatctcaacagcattggtcgggccgactatgtgtcagtcaccgacaatgaagcgcttgctgcttttaaaaagctgtgccgcgccgaaggcatcattcctgcgctggagtcggctcatgccctggcgtatgccctgaagatgattgaggcagaaccggaaaaagagcaactgattgtggtgaacctttccggtcgcggtgataaagatatcttcaccgttcacgatattctgactgcgcagggagaaatctgatggaacgttatgatcaactgtttacgcgtctggcggcgaagaaagaaggcgcactggtgcccttcgtcacgctgggcgatccttcacccgcgctgtcattacggattattgatgcgctggtagaaggtggggctgacgcgcttgaactgggcatccctttttccgatccgttagcggatgggccaaccatccaaagcgccacgctacgggcatttgcggccggtaccacgacggcacagtgctttgaaatgctggcagctatacgtcataaatatcctgaattacctattggcttactgatgtatgccaaccttgtattcagcaacggtattgatgagttctatgcgcgttgtgcccaggctggagttgactcagtgcttgtggcagatgtgcctgtggaagaatcagcgccgttccgccaggctgcgatgcgacatggcattgcgccaattttcatttgcccacctaacgccagcgatgagctactacgtgagattgcctctcacgggcgcggttatacctatctgttatcccgtgccggcgtcaccgggactgagaagcgggccagcctgccgctggatcacctgattgcaaagctacgtgaatatcacgccgcgccaccgctacagggctttgggatttccgaaccctcacaggtcaaagaatcgctcgcggcggggactgccggtgcgatttccggctcggctgtggtcaaaattattgagcagcatcaggccgaacccgaggtgatgctggatgccctgaaaaccttcattggtaacctgaaagccgctacccgctaatcgccttcatgccttaccgtccggtaaggcatgatttccctgttttttttcattaccggtttgctaatttcggatttcctgcaccacaattaacaggcgccgttatggtaacgtcgcatccaatttgtgacagggagagaagcaatgaaatggtttaaagtgctggcaagtgccatggtcgcggctgttgttgcattaacactgagcgcctgtgcgccaacgccaactaaagaaggcaccggcggttatattgatgacacagtcatcacgaccaaagtgaaagcagaactgttaaaagatgagtcgctgaaatcgactgaaattaacgttgaaacctttaagggtaaagtgcagctcagcggttttgtcagctcgccgcagatggctaaccatgcagtacaggttacccgcagcgtggccggcgtaagatccgtcgtcaataacatgcaaattaaataacgccgtatccattacacgaagggccacttttcagtggccctttttttatcagaagcggtaacctgccccgaagaagaatacccagggatcaacgcgcatatggatgttctgctgctgatcgccggctttgaatttcacgtcagtatcaatatccatgtaccacagagacgcgttcagcatccagtcacggttgatctgataatccagcccgacctgaccggctacgccccacgaatttttcagactcagatcgcttaagcccgcatcacgtccggtctggttaaaatccgcatcataaaaggtggtgtagttcacccccacgccgacatagggacggaccttactctggctgtcaaaaaagtagtactgtgccatcaacgtaggcggcagctgtcttaccgtcgccagggtgccggttgggccaagccccactttatgacgaaacggcgtggcggccagaagctcgaggccaatattgtcagtagccatataggtaaaggttaggcccagctgggtgtcattgctggcgctaaaggaccccattcccagcacattgtccgagccttcggtggggcgaacggtagcactccctgcacgcacaaagaaatcgccagcctgatgggccagcgcaaattgcggtaacgcaagcgccagcagcatggcgcatttagccagtttcatgttcactcctgtgagaaattaaatgcctgcactgaattatttttgcccgcacagatttagcgcgattctttggtaaatgcatctaaatcaacttagaaaaatgatttaaaaaacaatgaattgattcaagtcaattttacacctgctgctgcaggctaaatatctcttgccgaaataatatcgccgcattactttgctcttctttcctgactattttggttcgatgccttagaggtggcgggcgatcaaatgagcgaaaatatcaacccttgtattagctgtggtgcctgctgtgcccactttcgtgtctctttttactgggctgaagccgatgatgccggcggtctggtgcccacagaactcaccgagccgttgagtctgttgatgcggaatatgcgcggaactaacgatcgctcaccgcgctgcgtcgcccttaaaggcgatattggcggctgcgtttcctgcggtatttatgagaaccggccctcaccctgtcgtgagtttgacatgtccggggaacaaggtgtctggaatgaaggttgcgatcgggccagagcacggtacggcctccccgcactttttcacccatctttacctgttatgacagaaagttatccggttgcgggtgccagcgagcctccagaacatgtacaatcgccgggttaattaacccggttctttcaaggagagtacatgtctatcacggcaagctcgttataccgtgacactggaaatttttttcgtcatcaattgttcaccctggtgttaatgtcgctgctgaccgcgtttgtgacggtcatgctgttacacgttttaacgcccggtgaagatcaaatggcgattttgcaacaaggcgagataagcagtacgtcgctgtttgacctggtgcagagtatgacacccgaacagcaacaggtgctgctccgcgcctctgcagccgggacgtttgcgggcctggtggggaatacgctgctgttaggcggtatgctctgtctgattccgttagtctcttcaggccagcgtgtcagtgcactgcgtgcgataggcgctgccgcgcccttgctgccgaagttactgctgctgacttttttagtcaccttagtggcgcaactgggttttatggtgttggtggtgcccggcgtattgctgactattgtgctatcactgtcgccgattattctggccagtgaaaaactcggcgttatcgcctcgatgcgcgccagcatgcggatggcatggaaaaacgtgaagctgattgcccctgccattatcctgtggttactggcgaagcttgccgtaatgtttttctttacctcattgacggtattacctataaacgtttcaacggtcattttcaccgctataggtaacctggtttccactctgttagtgatttatttgtaccggctttatatgctgttacgttgattgtccgtgcgccgcccggcgcactggctggaaaggcagccttaactggaatgactatgaagcagctactcgactttcttccccttgttgttttctttattttttataagttgtacgacattttcgtggcgtcgggcgcactgattgtcgcaaccggtctggcactggtggcgagctgggtgctgtatcgcaagctcgagaaaatgaccatctttaccttcgttctggtggcggtattcggtacgctgacgctggttttccataatgatgagtttatcaaatggaaagtcacggttatttacaccctgtttgcgctggcgttactgtttagccagtggtttatgcagcagccgttaattcagaccatgctgggtaaagagctggagctgcctgagcacgtctggcgtaaactcaacattgcctgggcactgttcttcttgatttgtggtctggcgaacatatatgttgcattttggttaccccagtcattctgggttaactttaaagtgtttggactgaccggccttacgctgctgttcacgctcctgagcggcgtctatatctggcgtaagatgccgcaacaagaacaaaaataatcctgttgcccgtgttagcgggcaacgtttctcttacgatgacataagaaaccagagcaatggacgataaacataaattgccccagggcgaaatggtgatgcgcaccctggccatgccagcggataccaatgccaacggcgatatctttggtggctggttaatgtcacaaatggatatgggtggcgcgattcaggctaaagagatcgccgaaggccgtgttgttaccgttcgcgtcgatggcatgacgtttttaaaacccgtcgcggtgggcgatgtcgtcagttgctatgcgcaatgtattcgaaccggcaacagttcgatgacgatcaacgttcaggtgtggattaagaaagtctcttctgaaccgattgggcagacctactgtgccaccgaagcagtgtttatttatgtcgctgtcgataacgaaggacagcctcgccaactgcccgcagggcgggataatcagtcattcccttcctgataaagcgatgcatctacaatcccgctaacagcccgttcgcggtgagcgcttgtcacgtgtagatcgctcaccgctgcatcactttcgcccccggcgtcactcgatgctggccccgccattaattttgaacacgatattcatcgtcaaaccgctgcccggcttaccactttgataacgccacgtccgcatagcctgtttaacggtgcgctcaaacatgttacgcggctcagcagaaagaatgtcgatattatcgacccgaccatcgctatccacgtcaaatttcaccctgacgcgtccttcgatacgtaatgccgcagcccgaggcggataagacggcttactgatattaagcgctttaggcccggtggatacgctctgcgtcggtgctgccgacggcgtacttttcggggccgtcgtgggtttactttgcgttgcaggcgcatcctgcttaaacgggttcgcctgcggcttcacatcctgacgcggtttaacttcgcgttttggctgttcgtgcctgggctctggcttaggtttcggcttaggtttaggttgcggtttggggatcggcacaggcacgggcttcggcggctctggtgcgggttgaggctccggcacgggctccggttctggctggggttccggttgcggctcgggttgagcgactgcaggttcaggctgaacgtccggtgcaaccatggtcacgctaatcggctgcgatgccttgggcaactcaatggtctgatgaaaagacgcatagagaatcccgccaatgactgcaccgtgaagcgcaacagacaagatcatagcaacaggcgagcgtttaggtaagggcatagtcagcgtggtcataacaatcgcagtaatgaaatgaagtcccgattttaaatgcaaatagcaatcagtttcaataacctccttatgatgcggctaaaaaagcctatttagcccaatatgctgcgtaggtcattgacgcaaggtttcgtttgcactctacttaactatcacttaccgtgttgcaaaatttaagagttaatgggagcgcccaattgctttacgtcatttatgctgaagataacgccgattctctggaaaaacgcaacgccgtgcgccccgctcacctggcacgtctgaagttgttacatgaagaaggtcggctaatcgttgccgggcctatgcctgcggtggacagtaacgatcctggcgttgctgggtttacgggctctaccgtggtcgctgaattcccgtcactggaaacggcgcaggcctgggcggcagacgatccctatatcgccgcgggcgtttataagcaagtcagtgtgaagcccttcaagcgcgttttctgattcgactcccatgcaaaaaagcttccgggcagccgctctgaagcttttttttcgagatgatgttttatgcaagcgatcattttgaccctgttactggtcatcacgctgttagttggggcggcgctctgtctgtggcgcaaacacggctggcgtaataaaaaacacctgatagtgatgctgattgttctggccgccgcggtacagttggtcaacgtaaaattattgatgaccgggcagtagatttatcagccgctcaacgcggctgaatgattacagattttgcgtgataaacagaatggagcgacgttgctgctgcgccagttgatggcgaatcccgtgaatacgtttatagcgacgtgactgcccttccagccagcgcgaacgtcggcgctgtacctgacgcaacattctccagcgggcaacttcgtttctgctttttctcattacgtcctctctgacaccaaactcacgcgcaggcattataaagatctctgagccaatgccaaatcggatctttcatcgaaaagccgttattattaagggtttcgctcctctgcatctccacgtaaacttctcaaactcaagcgcgaacaggatgtccacttaatgaccacgttttacacgcttatcagctggttgttgttgtttggttactggttgctgatcgccggcatcacgctgcgcatcctgatgaagcgacgggccgtgacctcagccatggcatggctgctgattatctttattctgccactggtgggcatcattgcttatttatcctttggcgaactgcatttggggaaacgccgtgctgaacgggcgcgtaccatgtggccgtccaccgcccgctggctgaatgatttaaaaaagcgcaccgaaatttttgcaacggattacagcgacgttgcgcgcgctttatttcaattgtgcaataaccgccagggcattgcgggcgtaaaaggtaatcagctacagctactgaccagttctgatgacgtgatgaaggcgttaattcgcgatatccagctggcgcgtcataacgtcgagatggtgttctatatctggaatccgggcggtctggcggacgaagtggccgagtcgttaatggccgcatcacgccgtggcgttcactgccggctcatgcttgactctgcggggagcgttgcgtttttcagaagcccgtgggtgggcatgatgcgtaacgcaggcatcgacgttgtggaggcgcttcaggtcagcctgctgcgcgtattcctgcgccgcatggatttgcgtcagcatcgtaaaatggtgctgattgataactatattgcctacacgggcagcatgaatctggttgatccgcgcttctttaaacaagaggctggcgtgggtcagtgggttgatctgatggcccgaatggaaggcccggtatcgacggcgatggggattgtctatagctgtgactgggagattgaaacaggcaaacgtattctgccgccgccgcccgaccgcaatatcatgccatttgagcaggaaagtggccacaccgtgcaggttatcgcttccggccctggttttccggaagacttgattcaccaggcgctgcttacggcagtttattcagcacgtgagcagctaatcatgaccacgccctatctggtgccgagtgatgacctgcttcatgctatctgcacggcggcgttacgcggagtcaacgtgagtcttgtggtgccccttcataatgattctctgctggtcggctgggcaagccgctcattttttggcgagctacttgaggctggcgtgaagatctatcagtttgaagatggcctgctgcataccaaaagcgtactggtggacggtcagttgagcctggtcggcaccgtcaatctggatatgcgtagtttgtggctgaactttgaaattacccttgccgtggatgatgccggatttggcagcgatctggcctgtgtgcaggacgactatattgcccgttcgcgcctgcttgacgctaaacgctgggcaaaacgtgcctggtggcagcggattgtcgaacgactgttttacttctttagtcctttactgtaaaacgagcgaaattacgaactgcccttagataaacgggactgagaatggatctaaacaaccgcctgacagaagacgaaacgctggaacaggcctacgacatttttcttgaactggcaggcgacaatcttgatcctgccgatatcattctgttcaatctgcagtttgaagagcgcggtggcgcagagctgttcgatccgtcagatgactggcaggatcatgtggattttgatttgaatcctgactttttctcagaagtggtgatcggtctgggtgaagcggacggcgagccaattacggatgtcttcgcgcgcgtactgctgtgtcgcgaaaaagatcacaagctgtgccatattttatggcgtgaatagcggacagatggcaaataaacgccgggcaaatgcccggcgttttgctttataacgggtccaccttcaggcaggacaccgcgtgacggaaactgccttcaagcagcggtcgggtcttcgcacactctgggccggcaatcgggcaacgcgtacggaagacacatccagagggcggattaatcggggacggtaattccccttccagaagctgaatctgcttatttttctccaggtccggatcggggatcggcaccgccgacatcagcgctttggtataaggatgctgcggattggtgtacacctcatcgtaagtgcccagctcaacggcatgtcccagatacatcaccaatacgcgatcggagatatgtttcaccaccgccaggtcatgggcgataaagatcagcgacagccccatttcacgctgcagttgctgtagcaggttaaccacctgcgcctggatagagacgtccagcgccgacaccggctcatcgcaaatgatcagcttaggctcaagtatcaaggcgcgcgcgatgccaatacgctggcactgcccgccagagaactcgtgaggataacggttgatcaggttaggcaggagcccgaccttcatcatcatggtcttgacgcgatctttgatatcctggcgcgacagctccgggtgataagtgcgtaacggctctgcgatgatatcgccgatggtcatacgtgggtttaacgaggccagcgggtcctgaaaaatcatctggatatcgctacgcgccttgcgccactcttcctggctctgtcccagcaggttgcgtcccagccaggatacgcggccctctgtggccttaaccaggccaataatggcacgcgccagcgtagacttgccgcaacctgattcaccgacaacacccagcgtttcgccctcatacaggcgcaggctgaccccatcgacggccttaagggtttttggcggctgccagaaccactgcttgccatctttgatatcaaaatggactttcagatcggcgatttcgagtaagacttttttctctgccaggctgctcatacgagttcctccaccggcttaaagcaggcgcgtaaacgcccttctgcaaaaggtaacagcggcggtgctttagaacagatatccatggcatgaggacagcgcggctggaacggacaaccctgcggcaaacgcagcaggttaggcggattcccgggaatagtcgtcaggctttccccttctgcatccagccttgggacggcgttaagaaggccaatagagtaaggatgggctggctgataaaagacatcgcgtgcacggccatattccatcgtgcgtccagcatacatcaccagcactttgtcgcagatccccgcgaccacccccagatcgtgggtaatcatgatgatcgccgtattgaactcgcgcttgagttcattcagcaatgtcataatctgcgcctgaaccgtcacgtccagtgcggtcgtgggttcatcggcaatcagcagcttaggacgacacatcaacgccatcgcaatcattacacgctgacgcatcccgcctgaaaactcatggggatacattttcatgcgtttacgcgcttccggcatttttaccgcatccagcatttttatcgactcttcaaatgcctgggcgctgctcatgcctttatgcagcttcagcacttccattaactgctcgccaacccgcatgtaggggttcagtgaggtcatggggtcctgaaagatcatggcgatttgttcggcacgcagtctgttcagctgtttttcgggcaggttaaggatctccttaccgttaaacaacgccgacccgccgatacgaccattgctggccagcagccccatcagcgcaaacgcggtttgggatttgcctgagcccgactcgcccacaatgcctaaggtttcccccgcgcgcagtgaaaagttgagatcgttaaccgccgttacgtcaccatcgtgggtgccaaaagtgacgcgtaaatctttgacatcaagcagcagttcgcttcccgtgcgtgcagcctgagaaggctgaaattcatgaatagtcatcgggaaactccttaacgatctttggggtcgagggcatcacgcaggccatcgccaataaagttgaaacagaacaaggtgacaaccaggaaaaccgccgggaacagtaacagccatggcgagacttccatggagttagcaccatcgctaagcaatgcgccccagctactcaaaggctcctgggttcccagccccaggaagctcaggaaagattcaaacagaatcatactgggcaccagcagcgaagcgtaaaccaccaccacacccagtacgttagggacgatatggcgcgtcacaattttccaggtggaaacgccaccgacatgcgcggcttcgataaactctttacgtttcaggcttaaggtctgaccacgcacgatacgcgccatgtccagccaggaaaccataccgatagcggcaaaaataagcaggatattgcggccaaagaaggtcaccagcaggataacgaagaacatgaacgggaaggagttaaggatttccagaatacgcatcatcacggaatccgttttccccccgaggtaaccggcgattgaaccgtacagggtgccgacgatgacggcgatcagggcggcggcaatcccgaccatcagggaaatacgccccccaatggcgacgcgcaccaataaatcgcgccctgatgagtcagtgccgaaccagtgacccgaggtcgtatccggcggtgatgacatcattccccagtctgtatcgaaataggagaactgtgacagcataggcgcgaaaatcacaaacaacgtgatgagcatcagcaccatcaggctaattaacgcggcacggttatggataaaacgacgtcgggcatcctgccacaggctacgcccttcgacttccagtttttcactgaatgcatcaagagcttcgctatttttcttacttaacatcatggcgaactccagaatcagtagcggattttcgggtcgattacggcgtacagcacatcgacaatcgcgttaaacagaatggttaataaccccaccagaatggtcaggctcagcaccagtgagtaatcacggttcagcgcaccgttcacgaacagctgaccaatgcccggcaacccgtagatggactcaatgaccatagagccggtgataatgccgacaaaggccggtcccatataagaaatcactggcaacagcgcaggcttcagtgcatgacgtaatacgatacgacgcaacggcaaacctttcgcacgcgcggtacgaataaagttggagtgcataacttcaatcattgagccgcgggtaatacgcgcgatactggcgatataggcgagtgagagcgccaccatcggcagcagcatgtagttccattgtccgccgttccagccgccgccggggagccacttaagcgtgatagcgaaaaccagaaccaatagcggtgcgaccacgaaactgggtatcaccacgccggtcattgccacccccatcacaacataatcccacaggctgttttgtttcagcgccgcgattacgccggccgttacccccagcaccaccgccagaataaaggcggcaaggcccagcttggcagaaaccggaaacgcatggccgaccaggtagttcaccgaataatctttgtatttaaacgagggaccaaaatcgccgtgcgccagttgaataagataatcaacatattgcttgccgataggatcgttgaggtgatatttcgcctcaatatttgccatgacctctggcgacagcgtgcgctcgctggtaaaaggactgccgggtgccagtcgcatcataaagaaggagatggtaatcagaacgaaaagcgtcggaattgcttcaagcaatcgacgcaggatgaattttaacattgccgtacctaccaggctggtgcttcacattgcattaaaaaaagtacaggcggcgcgcgaggcgccgccgctgttcttggtatatgttctgttagtgcttgatgatatacaggtttttatcgtaggtgtaatccagtggatctttaccggtatagccacccacatacggcttcactaaacgtgtattgacgtagtagtaaagtggcacgataacggaatctttatccagaatctgttcggctttctgataatcggcggcacgggctttttcatccccagcagccaacgcatctttcatcaccttatcaaactcagggctcttatagtgtggcgtgttattactgctgtctgacagcatggtgttcaggaatgacgttggttcgttgtagtcggcacaccagccagcacgtgcaacatcaaagttgccctgatgacgcgtatccaggaaagttttccactcctggttctccagtttcactttgacgcccaggttttttgcccagattgaagaggcagcgatagccagctttttatgcaaatcagacgtgttgtacagcaaattaaatgtcagcggtttttcaggcgtgtaacctgcttcggccaacagttttttcgcttcagcgttgcgtttttcctgcgaccaggtaaaccagtctggttttaacaatgacatgccatcagttgccggtggtgtatagctatatgctggcttctgcccctgagccagtaccttatcgacaattatgtcgcgatcaagacccagtttaagtgcagcacgcacacgtggatcggtaaatggcgctttctggttgttaatttcataatagtaagtacacagatacggatcgacatgcagttctttaccgttatcacgctgtaatttcttaaacagctcaatcggcatattgttataggtcatgtcgctgccgttatcggagaagtagcggttaacatcactaacttctgaggaaatgggcaggaaagttactttgttcaatacagtgtgcgcattatcccaatactctgggttgcgtactaacgtaatgcgttcgttgacaacatgggaatcaagcttgaaggcaccattgctgaccatgttttgcggtaatgtccactggtcaccatacttctcgattgcgcctttattcactggtgacatcgatgagtggatcagcaatttgtaaaaataaggtacaggttcatccagggtgacctgcagggtgtggtcgtccagggctttgacacctagctcagacggacttttcttaccggcaataatatcgtcaacattctcaaggtgaccatattgcaagaagctagcataaggcgatgccgttttaggattcgccagacgctgccagctgtaaacaaagtcctgtgccgttaccggctcaccattcgaccatttggcatttttacgcagatggaaggtccagaccttaaaatctttattatcccagctttccgctacgcccgggattgggtggccatccgtatcactaatcaccagcccttcaaacaaatcgtggctgacgtttgattccggcacgccttcaattttatgcggatccatcgactggatttcgctaccgtttcctttaaccagctcctgcttcgcggccagttcaaccccagcaggtaccgtggctgccataacgctgttcgctgtgaacgcactcatcgctgcaaagacgctggcagcaatcagggttttcttcgtgatgttgttcattcataactccagttttttattttcactgagggtatttgcgacctcagcgttccccgtattcgggtccccggtgtttgcctgccggggagtattgaccctgtagtgtggtctgcacggtcacgcccttcccgactgtgccgccggttaagcgcgtgactcagtgttgtttaataaaataatatttcagatctgtcatgtcctgcggatcgtggccggtaaacccgccaatccagggtttgaccagtcgcacactgacgcgatagtaaactggcacaattgctgagtctttgtcgagttgtgtttcagcctgctgatacaataatgcgcgatcggcttcattctcagttgttaatgttgcggctaacaggcgatcgtattccgcgctgcggtaaaacgccgtattggtcgacgactgactctggaacatattgaggaaagtagagggctcattgtaatccgcacaccaggtggcgcgaaccacgtcatattgtgcctgatgacgtgtttccagcagggttttccattcctgattttgtaacgtcacctgcgcgcccaggttgcgttgccacatggacgcggcggcgatagcctgggttttgttttgatcagaggtgttataaagcagcgtaaaccgcagcgggtttttatcgttataaccggcctcggccagcaattttttcgccgcgtcatttcgttgcggctgagaccaggccatccacgcaggcgcggccaattttgcgccagcagtataaggcggcgtaaagctgtaggcaggtatttgcccctgtcccataattttattggcgatgatgtcgcgatccagcgtcattttgatggccgcgcgaacgcgcgcatcggtaaacggcggttttttgttattaatttcgtaataaaaggtgcagagcagcggactgactttcacttcatcgccgatgtctttacgcaatttagcgaacatgtcaggcggaaccgcgctgttggtcatatcaataccaccgctacgataacgattgatatcgctgttttccgagctgatcggtaaaaacgttccttgctcaatgacggtctggcggttgttccagtagcgcggattacgcttcaggacgattttttcattcactacccagtcgctcagcgtataggcaccgttaccgatgtagtggccgggttgtgtccatgcttcgccccacttttcaatcgcaggtgcatagacgggcttcatcgcggtgtgcgccagcattgccactaaatagggcaccggctcggttaaggtaacctgcagatggcggtcatcaagggcttttactcccagttggtctggggcggctttaccggcaagaatcgcctcaacattggcaatgtgcgcagcctgcaaataactggcataaggggaagccgttttaggatcggcaagacgacgccagctataaacgaaatcctttgccgtcaccggctcaccgttgctccatttagcattgtcgcgcagcgtaaatgtccagactttgccctgctgattttgccagctttcggcaacgcccggcacgaccttgccatcattatccgtgttaaccagcccgtccagcaggttgaggatgatgttcgactccggcacaccttctgtcttatgcgggtcaagtgaggccacttctgatccgttattaatgacgatttgttggtttgcggacaacgcgacatctgatggcacagtcgcggcactggtgggtaaaactgtcatagttaatgctaaacaagccagatagtgctgcgtgttcatttaccaacccttgttaagtgccaacttttattctgccatcccgtcatcaataaggaataaatcttattgtttggacattcgggaaaactttatcgatgcgccgaaaattagcagatgccgttgaggggcgccaaaactaaatagctaaaatgttacctgattctcttttatcatgagatttttcccagaggaagtgttaattttcgccataaaaatagcttaacagactgattaataaacagactcatcgatttgatggtaatttaaccaaaaaataacaatccagccgtttgactgtgttgttgtagggttatttcacctcgccccatcatttaaaaacgctttttgggacgtataccagcattaatcatgccaacttaggcagttaaagcagaatgtaatgtgaaaatagtgacagggtgggaatgcgggcaaggagtgggtgcaggaagctattagtggaagtgataactgctgagggatatgaagacagataaataattgcattaaaatggtgcaaaacaaccggaatttgcaccagattagcgcgcttcttattatttttatttaaataagtgccttttatccgaccagaccgggaaaaatcgctttaatcccggtaacgacaaattcaatccccagggccattaacaataaccccatgatacgggtgatgacgttaataccggtctgccctaacaacctgaccatcaagggagcagcgcggaacagtaaccaacagctgaaggcaaaaatggcaatagctacggtaaaacccagcaggttaagccagttatggtaacgggtactccagacgatggtagagctgatcgcgccagggccagccattaacggcagcgccagcggaaccacgccgacactttcccgaatggccgtctccgatttttcctgcttgttttgtttatcctcgcctagctttccgctgatcatcgacatggcgatcgtcacgaccagaataccgcctgcaatgcggaacgaatcgatagagataccaaaaacatgcaggatcgcatcgcctaaaaacagtgaggtccaaagaataatcgccacggcgagatttgccgtcagattggttttattgcgttcagccacgccctgataacgggtcatgctgataaataccggaatgatgccaatggggttaaccagtgcaaacaggcctacgaaaaacttgatatagccagacagatctaatagcgcaggattcacggttgactccacatcccagatgaaaaaacgcgcctaatgtaagggaaaaatgccctgggcgccagatgacctgttagttatttattctgttaatttacttacactttagcgcgttctaccagccattaaatatcctgcggtagatgttacttttattacggtctttttacttcgtcgtatggctgtgatcgcaggctggctgaaaggtgtcagccgcgatctaaattgatctgaatcatcattggtctcccccaaaccaggtactctttgcctgtcagcaacgcgtgtctcacgtttaaaccgcaagaaagcgcttttagtaaacaattgaaaacttgctgctttactcccgaaatggttggcatttgcatcataactatactcagggacccaggcttgtttactaaaaaagtttaacttcctcaggagagcacaatggccgttactaatgtcgctgaactcaatgcactggttgaacgtgtaaaaaaagcccagcaagaattcgccaacttttctcaacaacaggtcgatgccatcttccgcgccgctgcgctggccgccgccgatgcccgcattcccctcgctaaaatggcggttgcagaatccggtatgggcattgttgaagataaagttatcaaaaaccactttgcttctgaatatatctataacgcttacaaggatgaaaaaacctgcggcgtgctgcaaaccgatgacacttttggcaccatcacgattgctgaacccatcggcctgatttgcggcattgttcccacaaccaaccccacgtcgaccgctatctttaaagcccttatcagccttaaaacccgcaacggtattatcttctcacctcaccctcgcgccaaagacgcaaccaataaagcggcggatattgtactgcaggctgccatcgctgctggcgcgcctaaagacattatcggctggatcgacgcgccttctgttgaactgtccaatcagctgatgcatcaccccgatatcaacctgattcttgctacaggtggacccggcatggttaaagccgcgtacagctcaggaaaaccggctattggcgtaggggcgggtaacacaccggtggtgattgatgaaaccgccgatattaagcgcgccgtcgcgtccattctgatgtcgaaaacgttcgacaacggcgtgatctgcgcctctgagcagtctgtcatcgtggtggactccgtttatgacgccgtgcgtgagcgcttctccagccatggcggctatctgctcaagggacaggatctcagtgccgtacaaaatattattctgaaaaacggcgggcttaacgccgccattgtcggtcagcccgcggtgaaaattgcagagatggctggcctcagcgttccggcagaaacaaaaatcctgattggtgaagttgaacgggtcgatgaatcagaaccttttgcccatgaaaagctgtcgccgacacttgcgatgtaccgtgctaaagattatgaagatgccgtcagcaaagcggagaaactggtggcgatgggcggcattggtcacacctcctgtctttataccgatcaggacaatcagacagaacgcgtgcactactttggcgacaaaatgaaaacggcccgcattcttatcaatactccggcctctcagggcggcattggtgatttgtacaactttaaactcgccccctctctgacattgggctgtggttcgtggggtggtaactccatttctgaaaacgttggacctaaacatctgatcaataagaaaaccgtagccaagcgagctgaaaatatgttgtggcataaacttccaaagtccatttacttccgtcgtggctctttacccattgcactggaagagatcgctactgacggggcaaaacgcgcgtttgtggtgacagaccgcttcctgttcaataatggctacgccgatcaggttacccgcgtcttaaaatcccacggtatcgaaaccgaagtgttctttgaggttgaagcggaccccacattaagcatcgtgcgcaaaggcgcagaacaaatgaacagctttaaacccgacgtcattctggcgctgggcggtggttccccgatggatgcggccaaaattatgtgggtcatgtatgaacatccggaaacccatttcgaagagctggcgctgcgctttatggatatccgcaaacgtatctataaattcccgaaaatgggcgtgaaagcacgtatggtggcgattaccaccacctccggtaccggttctgaagtgacaccttttgcggtagtaacggatgacgccaccgggcagaaatatccgctggcggattacgctctgacgccggatatggccatcgtggatgcgaacctggtcatggatatgccacgttcactctgtgcctttggtggtctggatgcggtaacccatgcgcttgaagcctatgtgtccgtcctggcaaatgaatattccgatggtcaggcgctgcaggcacttaagctactcaaagagcatttacccgccagctatgcagagggggccaaaaacccggtagcccgtgaacgtgtacacaatgccgccaccattgccggtatagcttttgccaatgccttcctgggggtttgccactcaatggcgcataagctgggctcggagttccatattcctcatggactggctaactcgctgctgatttccaatgtcatccgctataacgccaatgacaatccgactaagcaaaccgcattcagccagtacgatcgtccgcaggcacgtcgtcgttatgctgaagtcgcggatcacctgggtctgacggctccgggcgatcgcaccgcgcagaaaatcgaaaaactgctgacctggctggacgaaatcaaaaccgaactgggtatcccggcctcaattcgtgaagccggcgttcaggaagccgatttcctggcgaaagtggacaaactggccgaagatgcctttgatgaccagtgtactggcgctaacccacgctatccgttaattgccgaactgaaacagctgatgcttgacagctattatggccgcaaatttgtggagccttattcaagtgccgctgaagcggcagtggatcagccggtcggtgacagtaaagcggcgaagaaagctaaaaaagcctaatcaggttaatgcccggtaatacgggctgtaaaaccccttgtctggcacgcgcctcaaggggttttttattacaattattgtactgttatgcagaacgtcgtcgctctcctggctagcgcgatgatcgcgatgacgaatgataacggtgtcctgaaccggacttattgattatttgaggtcaggcaacgcgacaggcttgaggccttaacagagaaaggtctggcaaaccgcagcgaatccattgagtgacgtcatcagtcgacgggcgtttgcgcgccatgaatggcctgcaaacatccctgctctatcgccttcttataatgcttacggcataccgagatataacgttcatttccaccaatcaccacctgttccccttctctgaaaggtttaccatcgctgtcgaggcgcagcaccatgcccgctttacgtccgcagtgacaaaccgtcttcagttcaaccagcttatctgcccaggccagcagatactgactgccgataaagagctcgccaagaaagtcggtccgcagcccgtagcacagtaccggaatatccaggtcatccaccacgtcagacagcgccttaacctgttcacgcgtcagaaactggctttcatccaccagaacacaatgcacaggctggcgtgcatgctcttgtgcaatctccacatccagttggctgtcagcattatacagtaccgccggtgaggataatccaatacgcgaactgaccttacctgcgccaaagcgattatcgatttccgcggtatagaccagcgttcgcataccgcgttcctggtaattgtaagatgactgcaaaagagcggttgatttacctgcattcattgctgaatagtagaaatagagttgagccatgtgcgccgtttctcagatatgatgaaacaaaataatggcgattttaccatatctgctccctgatgccgtggtgattttcagcatcttctgttcagattagcaccactaattgataatgtctggttaatatggcacggcgatttgtcttgtttaagagataaatattaaagcactttcatggttaaccattaatttaccctttatgcgcaagcgcattttccgctaagcgcttaatgttctcgttgattcacgggtacagctgccacacgttatcaggccgaattaataattcattaaattgcttctttcctctttttaagctaaaaattaatttaatgttgaagttatttttctccaccactactattagcgggcagaacaactctcctattaattattcagagatcaggacaatgagcgaagcacttaaaaatcttaataatatccgcacgctgcgtgcccaggccagagagtgttctttggaaacactggaagaaatgctggaaaaacttgaagtcgtggtaaatgagcgtcgcgatgaagagtcacactccaaagcagaaaacgaagaacgtgcgcgtaaacttgagcaatatcgtgaaatgctgttagccgatggcatcgatcccaatgaattattcggcgcgctgtcagaatcaaaaagttcaggcaaagccaaacgtgctgctcgccctgcaaaatatcagtttgttgacgaaaatggcgatgctaaaacctggacaggccagggccgtacgccagcagcaatcaaaaaagccatggaagaacaaggtaagcagttagacgacttcctgctgtaatgaatggcgtgtttcgctctttgttggcttcactttagctatttgattaccaacaccaaaaaaaaggaagcgactgcttccttttttatttttcacaccgagtaaaaattacggtaccagtcaacaaagcgtctgacgccttcatcgacaccggtttgtggtttaaatccaatggcattatataacgctgtcgtatcggcgctggttgccaggacatctccgggttgcattggcatcaggtttttattagccgatatgccaagcgctttttcaatcgcctcaatatagtgaatcagactcacaggctggctattgcccaggttataaacactatagggggctgagcttgacgcggcagaacccgtttcaacggtccagttaacatcggcttgcggaaccacatcctgcaaacgaacgatcgcctcgactacatcatcaatataggtaaagtcgcgcttcatttgcccttggttatacacatctatcgcttcaccggcgagcattgcccgagtaaatttaaacaatgccatgtccggacgtccccacggaccatataccgtgaaaaaacgtaatccggttgtgggtaattgataaagatgtgagtaagtatgcgacatcagctcattggcttttttggtcgctgcatacaatgaaaccggatgatcgacactgtcctctgttgagaatggcatcttgttatttaagccataaaccgaactggatgacgcatagagcagatgttcgattttatgatggcggcacccttcgagtatattcaggtgcccaataacgttggcatcggcataagcatggggattttcaatggaataacgtacccctgcctgagcggccaaatgaataacgcgttgaaagttgtgctgtgcaaaaagtgcggcaatagcctggcgatcggccaaatcgactttgatgaaggtaaaagacggattatcgccgatgacatcaaggcgagcttgtttaaggtttacatcatagtagtcattcaggttgtcaataccgacaacctggtgaccggcggccagcaggcgttgacttacatgaaagccaataaagcctgctgcgccggtaaccagaaaattcataaatccctcactaattatatagcctgaatagatgctccacggccgattgcataataaacgaagccgcgtttgttgagacgctcgggatcatacaggttacgcccatcaaaaataacgggttctttcagtgcattcttaatagcgtcaaagtcaggtgcacggaagttctgccattccgtacaaatcaccaggccgtctgcaccgtgcaatgctgcctctttggtgcccatcagcttcaaatcatcgcgatgaccatagatacgttgcgcttcatccatggcttcgggatcgaaggcctgaacggatgcgccagcttcccataaggtttccattaacacgcgacttgatgcttcacgcatatcatccgtgttaggtttgaatgacaacccccacagggcaaacgttttacccttaagatcgtcaccaaagtggcgtttgataaaggtcggcagcttggtcttctgactgtcattgacgtcttccaccgccttcaacaggcgtggcgtatagccaatggattcagccgtacgaataagcgcctgaacgtctttcgggaagcaggaaccgccatagccgcagcctggatagataaagtgatagccgatgcgtgagtcagacccaatcccctggcgcactttttcgatatccgcgcctaaacgttctgcgagattggaaatttcgttcataaagctgattttggtcgccagcatgcagttagccgcgtacttagtcagttctgcactgcgaatatccatcaggatcatgcgatcgtggttacggttgaatggctcgtacagctcacgcaacagctccacaacatcgtcattgtccgtccctacgacgatacgctccgggcgcatgcagtcattaactgccgcaccttctttcagaaactctgggttggacaccacatcaaagctgatgttggcatcacgcgccttcagggtttctgtcatgacggcacggacacggtcagcggttcccactggcactgttgacttatcaataacgactttgtgatcggtcatatgctgagcaatggtacgtgccacagcagtaacatatttcaggtcggccgagccatcttcgtcaggcggtgtacccacggcgataaactgcatcacgccatgattcacgcccagtgcagcatcagtgctgaacttcagacgacccgattcgtaattcgacattaccagcggcgtcagacccggttcaaaaatggggatcttgccttgtttaaggttttcgaccttcttttcatccacatcaatgcagagaacgtcatgtccgacttcggccaacaccgcagcctgaaccagaccgacatagccgataccaaatacagtgactttcattgagctatcctgtgtttaaaattactttttatcgctaacggttttgttgagccattctgtgaactctttgcccaacaccggatggcgaacaccatattcaacgaaagcctgcatgtagcccagtttgttaccacagtcatgacttacccctttcaggtgataagcttcgacggtttctttgtccatcagcatggcgatagagtcggtgagctgaacttcgccccccgcacctggaggcgttttcgccagcagaggccagatgtcagcagacagaacgtaacgaccaacaaccgcgaggttagatggggcctcagacgctttaggcttctcaaccacgcccaccattggtgcgctgtcgccaggattcagttctgcaccctgacagtccacaacaccgtaagccgtcacatcgctgactggctcaaccatgatctggctgcggccggattcttcataacggctgagcatttctgccaggttatctttggttgggttagattcgtattcgtcgatgatgacatccggcagaataacggcaacaggctcatcaccgatcaatggatgcgcgcacataacagcgtggcccagacctttagcgataccctgacgtacctgcatgatggtcacgtgcggaggacagatagactgaatttcgtccagcagctgacgcttaacacgtttttccagcatggattccagttcgaaactggtgtcgaagtggttctcaatggcgtttttagatgagtgagtaaccagtacgatctcattaatacccgcggcaatacactcgttaacgacatactgaattaacggcttatcaaccagcggtaacatttcttttggaatcgctttggtagcaggaagcatacgcgtccccaaaccagctaccggaattaccgctttcttaactttggtcttataggcagacatcaaaatacctctcttataggccgttcacgttttaatgcttgatatgtcggtttaaattcggaaatgagtatatcagttactcgcgaacggatttatcctggaagacatctatccggagaatttaagactattacccaagtataaagctaacttctggccctgtcttgcgggcgataataaaacattcatcagggtttactgatcagacgataacatcagtcgtatgcggcctccggccccccaaatatggcattgccagtcatccgcacgctgactaatttggttagtatgtgtactgcccatagtgccaagaggtacaccgttactgagttgtatttgatgggcctgaacatgcaaagtggcatttaatcccgctgaaaccagcaccaaattttttaatccgcgatggtaatatcccaccaacaacggaaactggccggttaagttagcctggcgcagcagtaaattaacctgtctgagcaaactgctcagctccggcaaacgctgcttttgtcctgataactgctcttgcagtaatccattaaataatgcgcgcaggagcaaagcggccaaaacgccgttgtcgccggcgcgagtgacatcaagacaataaaaggcgaggtctttatcagaaagcgcggcaatatccagcaccagaccgggctgctcagccattgtcagttggcgataattaattcggcagttagcaatacgttgctggacaggcggctgaagctctttaaggagttttgctgccgctgacggatcgcgaaccagcgcatcccagtcctgaaacagctgttcgtcttcctcaaccttcgacgtaaacatggaggggtaaaggcattcgtagaccgcctcgcgaaagcgctcgaagttttttaacggcttgagcagcacatcctgcacgccaagacgcagcacctgcgcgatatcggacatattttccgtggccgaaatgatcagaatcggcacgctgttgccacggctacggacatgctcgacgaattcgatgccgctcatgacaggcatctccagatcacaaatgaccagctccacagaatgctgcttaagttgctcaatagcctgcaggccatcttctgcttcaaccgtgacagcacccatggacgacagaaattggtttaatagcgaacggaaaacggcctcatcttcgacaatgagtatctttttgccgatcagtggtttttccattccatccccctgcgtacccgataattcaatagtggttcataaaacgcagttgcgcctttcagaatagaccgaagtaacatctgtgcgtgaacaaccagattatcttctacggaccagcggtaataattcatccatttgtttctcaacggcaaccttccccgccgcaatagcttcttcagcacgatgaaagtccaacgtggatatttgtggacaaaacggctggatgagcacgtcgggcggatcgcctgccatccggtttcgcttcaggcgattttccaaaacctggattgaagtggccatgatctccattgcacccggcatttgtgatgcccgtcgctgggtaaaactgaccagtctctggcgcaactttccgcgccagtcgagattgagcgcaaccgctgcggcatgttcctcagtactttggggcgtcagcaccattgagttgggttgcatgaggtgcgcatcgtgctgaagatccacggcaataaccacatcggctcccagtgcccgagtcagtgaaaccggtaccggattcaccacggcaccatctaccagccaataaccattgtagccgaccggtggcaataagcctggcatactacaggaagcgcgcacggcctgatgcaattctccctcggtgagccataattcacgtcccgtgcttaagttggtcgccaccacgccaaaaggcttgtcacatgcctcaagcgcattgttggtgataagctgacggacatgattaaacacccgctcaccgcgcagaagtccaccgcgctgccaggaaagatccattaagcggatgacatcccagtagctgaaggcgctgacccattttttcatgtgcggcagccgatgattgacataagccgcgccgacgagggcaccaatggaacagcctgcgacgacatcaatttcaatgcctgcgctttccagcgcgtcgatgacgccaatatgcgcccatcctttggcggcaccggaacccagagccaatccaatcttttgttttctcatcttgctcgggtcctggcgtcaatacatagcgtcacaagcgtgggtcggataaagtaaacgatatcatcaacacccactgttactcacaggagaatatgtgtccgaatcttgcccatgttgtagcggcaagcagtatagcctatgttgtcagccctttgttaaaggaacagaaattcccttatcagctgaacaacttatgcgctctcgctactgcgcttacgttaaacacgacgtcgactatttagtgtcgacctggcatcccaccaggtgcgatcccgcgcttgccgggctgttgtctgaaagttttgctggtactgaatggctgagtctgaacgtcacgcactgtgagccggggcgtaatcaggatgaagcctttgtggcttttttcgcccgttatcgtgaaaacggtgttaatcgggcgatgtacgagcgttcacgctttcttcgcgaggatcaacgctggtactatgtagacggaataacgcccgctattgggcgtaacgatcgctgtccttgtggcgccgataaaaaatacaagaaatgttgcggctaaggcagttgcctgcgtaacggttttacccttaatgctttgacaggactctgattgagatgcaagcgcaaaccatgcaaagaaaagttttacgaaccatttgtcccgatgcaaaaggtctgatcgccaaaatcaccaatatttgttacaagcacgaactgaatatcgtgcaaaacaatgagtttgttgaccatcgcaccgggcgtttttttatgcgcacagagctggaagggatttttaacgatacgaccctgctggccgatctcgacagtgcccttccacaaggttccgtacgtgaactgcacagcgcaggtcgtcgccgtgtggttattttgatcactaaagaagcgcactgccttggcgacctgctgatgaagagtgcatttggcggtctggatatggaaattgccgccgtcatcggtaatcacgatacgctgcgttcgctggtggagcgtttcgatattccgtttgtcctggtcagccatgaaggtttgtcacgtgaagagcatgacaaccgtatggcagaagaaattgaccgttatcagccagattatgtggtgcttgccaagtacatgcgcgtgctgacgccgggttttgtgcagcgctatcccaatcagatcattaacattcaccactcattcctgccggcttttatcggcgcgcggccttatcaccaggcttacgagcgtggcgttaaaatcattggggcgacagcgcactatgtgaatgacaatcttgatgaaggcccgatcatcatgcaggacgtcatcaacgtcgatcacagctatacggcagaagaaatgatgcgtgccggacgcgacgtcgaaaaaaatgtcctgagccgcgcgttagataaagtattaggtcagcgcgtgtttgtttacggtaaccgcacgattattctttaaccgccacggcgctggattggctgacattccagcgctacgggtaaaaagtggacaaacggttcaccatttgccagtcggcgctttacagtcctggcgcatttggtatgatgcgccccgcttcagagcacaacaattcagtccctggtgggattcccgagcggccaaagggagcagactgtaaatctgccgtcacagacttcgaaggttcgaatccttctcccaccaccatctgaatctgctgcctgaacacacatatcatccccggtgggattcccgagcggccaaagggagcagactgtaaatctgccgtcacagacttcgaaggttcgaatccttctcccaccaccatcacgaaaatgctgcctttctgccctaagaaaccaaaaccatcatagttatctggggagagggatgagaaccttcgactaaggttcgagtcgagcagcgcgagacaacgcgcgtcagcgcggcccgcagggtgaggcgcaacgcgccgaataatccttctcccaccaccatcacgaaaatgctgcctttctgccctaagaaaccaaaaccatcatagttatctggggagagggatgagaaccttcgatcaaggttcgggtcgagcagcgcgagacaacgcgcgtcagcgcggcccgcagggtgaggcgcgccgaataatccttctcccaccaccatcttaaatattctcctgatctgcccaagataatcccaatcaccctattctgctgggagagggatgagaaccttcgactaaggttcgggtcgagcagcgcgagacaacgcgccgaataatcctgacatcaagcccccctgatacagcctgtctaccactcgttgaaattgccctgctctgccatgacttttactgcaaaaatcgctaccatcctgcttatcattcgctgaaggtcatcccatgaaatttatttcatttaacattaacggcttgcgggctcgcccccatcaacttgaagcgctggtcgaaaaacatcagccggacgtcatcggactgcaggaaaccaaagttcatgacgatatgttcccgttagaagacgtggcaaagctgggctataacgtgttttaccatggtcagaaaggccattacggcgtggcgctgctgaccaaagttcagccggtgtccgtgcgccgtgggtttccgggcgatgacgatgatgcgcagcgtcgattgatcatggccgagatccccagcccgatcggtgatatcaccgtaataaacggctatttcccccagggcgagagccgtgaccatccgacgaaatttccggcgaaagagaagttttatcgcgatttgcaaagctatctgagtgacagcctggccgccgataagccggtactgatcatgggtgatatgaatatcagcagtaccgaccttgatatcggtatcggtgaagacagccgcaagcgttggttacgcaccggtaagtgctctttcctgccagaggaacgtgaatggatggatcgcctgctcagttggggcctggtcgatacatggcgcgcacagaacccggacgttaacgaccgtttttcctggttcgactatcgctcaaaaggctttgatgataatcgcggcctgcgcatcgatctgctgctggcgagcaccgggctggcgtcgcactgcattgaaaccgggattgattatgacatccgcggcatggaaaaaccgtccgaccatgccccggtctggtcaaccttccgtttctgatacggccctgacgcgtggtaaaaagccacgcgtttttatttcacaattttccaaatcaaattgttagtacccagcgatttctcatcgcgcgcacactgtagcagcaccccttctgacttcactaccgcgccttccgtataattacggttttcaaaaatacagcactgcagacaattctgctggcggttttgtccctgcgtccaggcttccgctggcatattaacgatcacatcggtatcgctaccgcctgcatcaccctgttggtgacgatagttagcctgtgccgggttgcaaacagccatcacagccaggaggagccatgctgatttcattattcggtttccttagttttacgccttgctttacgctgcggacgtttttgtccggtggatggtaaaccacgaaacgccggtcccgacggctgctgccgcgcctgctgaattaacccgctcagcgtttgtaccagcggctgcataaactcatcgtaacgacaggctttttcactgatacgcgtcagggtcgattcccattgagccgtcatatccggccgggcagcgagatccggtaatgaatggatcaatgctttgcctgcatcagtcgaatgaatatagcgtcctttcttgtgtaaaaatgaacggcggaacaataactcaataatgcctgcgcgcgtggcttccgttcctaaaccatcggtcgcacgcagcactttctttaattctttatcctgaacgaagcgcgcaatgccggtcatggccgacagcaaggttgcatccgtaaaatggcgcggcggctgagtctgcttcgccagtacctcaccgcgctcgcacagcagcgcatcgtctttcgcgacgacaggcaacggcgtgccatcattttcttcatcacgctctttaccgccgagcagcgctcgccatcctgcctcagccagaaaacgggctttggcaacaaatttaccgcccgcgatatccagatcgatggtgcatttacggaacaccgcatccgggcaaaactgcattaaatattgccgggcgaccagtccataaacctgctgttcgttttcgttaagcctgacggcgctggcgcgagcggtgggaatgatggcgtggtgcgcatccacttttttgtcatcccaacagcggtttttgcggtctgcatcaaactccgctggtggcgtcaggtcaggttgatgcgcctgaatcgcattgagtacggcgtggcgaccggcaaaatgttcgtcgggcaaataacggctgtcagaacgtggataggtgatcaacttatgggtttcatacaaacgctggcacacatccagtaccgcctgcgcactcagcccaaaacgtttagccgcctcgatttgcagagtagagagagaaaaagggagcggcgcgatctcgttctcgcgcttgtcattgtaggcggtaacgatagctggctgaccgctgatgcgtgccaccacatgctccgccagcgagcgtttcagcagccgaccttcttcatcctgccagggctcacaggcttcgctggggacccagttggcggtaaagcgactctcatccggcgtcacaatgtgcgctttgacttcaaagtaatctttggggacaaaattcgcgatctcttcgtcccggcgtaccaccagccccaacaccggcgtttgcacccttcccactgacagcacaccatcatagcccgcattgcggcccagcagcgtccaggcgcgcgtcatattgataccgtaaagccagtcggcacgtgcacgcgccagggcggacacgcagagtggaataaattcgcgattctcacgcagccggttgatggcccgttccaccgcttgtgggttcaggtcgttaatcaggcagcgctgcactttactgcgtttctctgcggggagttgcagataatccagcacttcatccactaacagctgcccttcccgatcggggtcacctgcgtggaccacttcatcggcctgcgccagtaatccctccaccactttaagttgtttcgcaacggaaggccgcggctgcagacgccatttttcagggataatcggcagatccgccagcgaccagcgcgcataacggctgtcgtaaacatcaggctgcgcctgctcaagtaaatgccccacgcaccaggtgacaatctgatcattgccgcaggcgatgaagccatcaccacgccggtgcggtttaggcagcacgtcggcaatggcccgtccaaggctgggtttctctgcaataaacaaacgcattaaatcgggtaatccttaacgtcagcaaacaacaagggtgacagcgcaaaccggtcagcggagggttgagcggcacgatgcctgccccttagcccgctgaacggttgcatcacacgcacaggcctggagaagagtatgcgctgccagatgaagcagcgctatggtagcctggcggcgcgcggctgataagcgcgtcgggttcaatgcggaactattcgcacaataaccgcacaatctctcgtttgggagcgttcagaaatagcgaacgaacggcgccgtgtcgggatgtaccacggtagtgctggatttcagctgcggtgtgcccaggtaaaggaagcccacaatagcgtcctgttcccggcaaccgaacgcgtcgcgtacctgcggatcgtcggtccagggaccgcttcgccagataccattaaagccctgggcgaccgccgccatctgcatggccatcaccgcgcagcttgccgaggcgatttgctcccagcgaggcaccttgtggttcagctcacagtgggccacaacggtaataatcatcggcgcacgaaacggggcctggctggctttgttaatggccttttcatccagttgattgtcccgcgccgccttctcaagcagctggctgaggcgatcgcggccctcgttttccactatgataaagcgccacggttgcaaggtaccgtgatcgggcgcgcgcatggcggcgcgcaggatattatccagcacctcgccgccgggggctggctccgctaagcgggaggccgagcgacgattaaccaataattcaagtgcatccatgtttttctcctgaggggttaaagcacgcataatcctggcacaggtggattttttgtaacagtccagggtgatttcctgctgacttttgttgcgccgctctttaggatgaggtcgtcaacggagacctggcctacaaagcggctatttccggtatatcaatatggagagtgtgatgcgcacattgtggcgaataattgctggtctgttccgcgggatctggcgagtgttgaactttatcagggaatgtatccttaacctgttcctgattttcttgattgtcgtctgtgtcgggatctggcttcaggtcagcggctcaggcagtcattctgccccggtgcaacaaggcgctttaaaagttgatctgaccggtgtgctggtcgataaaccttccgtcagcaatcgcctgagtaaaattggtcgccagttattaggcaccagcagcgaccgcctacaggaaaactccctgtttgatgtggttgatgcgattcgtcaggcaaagggcgacagcaatattaaaggcatggtgttagatctgcgtgactttgccggcggcgatcagccgtcgctgcagtatgttggtaaagcgctgcgcgaatttcgtgagagcggcaaacccatttacgccttcggcgacagttacagtcaggcccagtactaccttgccagttatgcgacaaaaatctacctgtcacctcaggggaccgttgacctgcatggtttcgccaccaatgggttgtactacaaaacgctgctcgacaagctgaaggtcaattcacacgtcttccgcgtcggcacctataagtctgctgttgagcctttcctgcgtgatgatatgtcgcctgccgcgcgcgatgcggacacccgttgggtgggacaactctggcagaattaccttaataccgtgtcggctaaccgtcagatcacccctgatcagctgttccctggcgcggcagccatcattgccggcttacaggccgttaaaggcgataccggtcagtatgcgctggataacaaactggtcgatgttctgggctcacgtgctgatgccgatcagatgctcatcaagacctttggttttgataaacagagcagcgattatcgcagcgtcagtatttatgactacaacgttaaaccggacgccagccaacagaaaggcaatattgccgttgttatggccagcggcgccatcatggacggtgatgaaacgccgggcaatgtaggcggtgataccacggcggcacagattcgtgatgcgcgactggaccctaagatcaaagcgatcattttgcgggtcaacagccctggcggtagcgtaacggcctcggaagctatccgttccgaactggccgcggcgaaagccgccggtaaaccgattgtggtttccatgggcggtatggcggcttctggtggttactggatttctaccccagccagctacattatcgccagtcctgtcaccctgaccggttctatcggtatcttcggcgtgattaatacgctggaaaacaccctggacagcatcggtgtccatacggacggcgtcgcgacctcaccgctggcggatgtcgccagcaccaaagcgctgccgcctgaagtccagcagttgatgcagttgaccatcgaaaacggctaccacaattttgttgggctggttgcgacctcacgtcacaaaacgccggagcaaatcgacgccatcgcccagggtcatgtatggaccggaagcgacgcgaaagccaatggactggtggatgcactgggtgattttgacgatgcggtgaagaaagcggccgagctggcgaaggtttcacaaccgcagcttgactggtatcaggaagatcccggctttgtcgatttgatgctgaaccagatgaacgcctctgttcaggccgtgctgcctggccagctgaaagcctggctgcccgcgccgatgtacgatgtcatgagcgccatgcgaaatcagcccggcctgttcgaccatcttaacgatccacaaaaccgttatgccttctgcctgacctgcggtgaagtgcgataaacctctcagcccgactgctggtcgggctgcttttccctgctgttgcccttatactgcgcgttttacagcaagtctgagttcacctatgcaaaagaaaaacatctacgttgcctataccggcggtaccatcggtatgcaacgctctgctcaaggttatattccggtttcaggtcacctacagcaagaactggcaaaaatgcccgaattccatcgcccggaaatgcctgacttcacgatccatgaatatcagcccctgatcgattcgtccgatatgacgcctcaggactggcagtccattgccgaagatatccggctgaattacgaccgctatgatggctttgtaattctgcatggtacagataccatggcttttaccgcgtcagcattgtcatttatgctggaaaacctggcaaaaccggtcattgtgaccggctcgcaaatcccgttagccgaattgcgctcagatggtcagcaaaacctgctgaactcgctgtatgttgccgctaactatccggttaacgaggtgacgctgttttttaataacaccctctatcgcggtaaccgtacgacgaaagctcatgccgacggatttaatgcgtttgcctcacccaatctgtcagccctgctggaagccggcatccatattcgccgtctgaacacaccgcctgcgccgcaaggtcagggcgagctcatcgtacatacgatcacgccgcagcccattggcgtggtgacgatttatcccggcatatcggcggatgtcgtgcgtaactttttgcgccagccggttaaagcccttattttgcgctcttacggcgtaggcaatgccccgcagaacgccgagttcctgtctgagctacagcaggccagcgagcgcggcattgtggtggttaacctcacccaatgtatctccggtaaggtcaatatgggcggctacgcaaccggaaatgcgctggaacatgcgggcgtcatcagtggctttgatctgacggtagaagccgccctgacaaaacttcactatctgttaagtcaggatctctcaagcgagcaaatccgtgccaaaatgcagcaaaacctgcgtggcgaactgaccgaagattgagacggagcaaacgggaatgaaacgggcactgatcattattgatattcagaacgacttctgccccggcggccccatggccgttacagaaggcgatcatacggtagagattgctaatcgctatgcccgtgcctttcgcgaaaaaggtgagtgcgttgtggcattacaggactggcaccctgccaaccatggcagttttgcctccgtgtctggtgagccggtttataccctgggcgagcttaatggtctgccccaaatctggtggccggatcatgggattcagcactcaaccggcgcagactttcatcctgggcttgatcgcagcctgttcgacgcggtcttccacaagggtgaagatcaggacgttgacagctatagcgccttttttgataacggccaccggcgtaaaaccgagctggacagctggttacgcgcgcgcgacatcacgcatctggtgatgctgggcctggcgaccgattactgtgtgaagtacagcgttctggatgcacttgaactgggctatcaggtggacgtggtggcggaaggttgccggggcgtgaatctcaatcctgaagacagcgaaattgccctggcgcagatggcagcacagggtgcggttattatctgaagctgaacgtgaagggttggcttgttgccagcccttcacgtctcgaacggcctgtcactttcacaggctgtccaggcttaatgcaggttgatacgagtcacgtctggctcaatgccaaactcatctttcaactgctttttagacttggtgaccatctcgccgtctttgccgatcgtcatatgctgtggggcctcgttattccgcgcctgccacatcatcaccagttgcaggctgttatcacgctgctgctgggtaagcgccacgccatccggccattttccggtttccacagccataaccagacggtcatagatttcaggcgtcatggcatcaagcatcgcgtcaagttgctgtttcatcgttatcctttcgtctcgtcaccttgctgatcggtaaagttcagcgaggcggaattaacacagtagcgttcaccggtcggttgtggaccatccgggaaaacatgaccgagatgggcatcacaactgccacaacggatttcaacacgctgcataccatgtgaattatcttccagatagcgaatcgcgtcatcgcttaccggctgatagaagctgggccagccacaacctgagtcatacttggtgtcagacaaaaacaggggagcgttgcagaccaaacagtggtagatcccttcctgcttattgtgcagcagcgcaccgctgtacggtggctccgttccacgctgctgcgtgacataacgttgcatctcagtcagttgggcgatttttgcttcgggtgcggtttctttaggcatttgagcaattccgggatgtcattctgtaaaaatcgactactattctaacaaacgatcaacattagtcgggtctttttttgtgctcaacccttcagtccgtatcctacaaggtagatttgtgacttcgatcaccttttctctggcatatccctatatattcggcgaaggattcaacagagcacgtttttttcaggtgcgcgcaagcggttgcggcacaaataattcctgttgagtggattgacctgtcgcaacaattgacacgattccgcttgacgcctggtaaggtttttgtaattttacagccaaccttttattcactaacaactagctggtggaatatatgactatcaaagtaggtatcaacggttttggccgtatcggtcgcatcgttttccgtgctgctcaacagcgctctgacatcgaaatcgttgctatcaacgacctgctggacgctgactacatggcgtacatgctgaagtacgactctactcacggccgttttgacggcaccgttgaagtacaggacggcgctctggttgttaacggtaagaaaatccgcgttactgctgagagagatccggctaacctgaaatgggacgaagtcggcgttgacgtcgttgctgaagcaaccggtatcttcctgaccgacgagactgcacgtaagcacatcactgcaggtgccaagaaagtcgttctgaccggtccatctaaagatgacaccccaatgttcgttcgtggtgcaaacttcgacaagtatcagggtcaggacatcgtgtctaacgcctcttgtaccactaactgtctggcaccactggcaaaagtgatcaacgacaagttcggcatcgttgaaggcctgatgaccaccgttcacgcgaccaccgcgacacagaaaaccgttgatggcccgtctcataaagactggcgtggcggtcgtggcgcgtctcagaacatcatcccttcttctaccggtgcagcgaaagcggtaggtaaagtgctgccagaactgaatggcaagctgacaggtatggcgttccgcgttcctactccaaacgtttctgttgttgacctgaccgttcgtctggaaaaagcagcgtcttacaaagaaatctgtgccgctattaaagccgcttcagaaggcgaaatgaaagacgtgctgggctatgttgaagatgacgtggtttctaccgatttcaacggtgaaatcctgacgtcagtattcgatgctaaagccggtatcgcgctgaatgacaacttcgttaaactggtttcctggtatgataacgaaaccggttattcaaacaaagttctcgacctgattgcgctggtttctgctaaataaggcagccagacagaagagaataagggtgacttcggtcaccctttttttgatccatttcgtaaggagtcgggcatgcaagacaaactcttttctctccccgtggttaaacagattacgccttacctgtcacagcgtcaggtcggggatcttccggcaatcgttgtcagccatcctcgcgtgcgtgcggccataactttacagggcgctcaccttattgcctggcaacccagcggggaaaagcacgtgctgtggctgagcgataaaagccctttctcgccaggtaaagcgattcgcggcggcgtccccatctgctggccctggtttggacctgcgggtgaaccggcgcatggatttgcccgtaatcaatcctggaagctgtctgctcatgatgaaaacgaagaaggcgtgatcttaacgctggtgctggaaagcaacccacagacgctgaagttatggccacacgaatttacgctgatagcacgttttcgtcttgggcagcactgtgagatcgaactggaagcctatggtgactatgagtccaccgctgcgctgcacagctactttaacgtggcagatatcaatggggtcgatgtctcgggactgggtgatacctatatcgataaggttaacgacaatcaggaaggcaccagtgacggtaagcagcgttttaccagccgggttgaccgtatctttactgcggcaaacgactgctccgtgattaacgatcaggtgggacagcggcaaatcgaggtttatcatcaccaccaaagtgacgttgtcacatggaacccaggcgttgagctgtcctgcagcatgacagacatgcccaacgaaggttacaaaaccatggtttgtgtggaaacggctcgcatcagcaaaccgttacgcagtgcgggcgaaaaaccggcccgactggcgaccacgattcgtctgaaagggaaatcgagttaaggcttaagggcgcttttcatacgacgtccagtggcattttgtgccgcggcggcgggaaagctttgtcgatcaggaaacactcctcatcactcaggctaatatccagcgccgcggcattttcctgcacatgcagcagtgagctggctttagggatagcaatcacacccggcgcacggataacccacgccagcagaagctgagcaaccgtaatccccttctgctgagcaatggcgaccagggttggctctgaaaacagccgattgcgtaagcgtcctgcctgagccagcggacaataggccattaccggcatcgcatgctgctggcacaggggcagaagatcatattcgataccgcgtgaagccagatgataaagcacctgattggttgcgcaggcttcaccaccggcttcggcccacagctcatccatatcatcgctgtcgaagtttgaaacgccccaatgcacaatttttccctgctgctgcaggctttgcattgcgcttatggtttcgtccaggggcacactgccacgccagtgcagcaggtagaggtcaaggcggtcggtttgcaaacgccgcaggctggcttcacaggcggctatcgcgtcatattctccggcattccatgggtaaactttcgataccagcaacgcgctgtcacggcgcccttttagcgcctcgccgaccacctcttccgccccgccatcggcgtacatttcggccgtatcaataattttcaagcccgcatccagcccagcctgaagcgcgctgacttcctgctgtcggctgttgctgtcttcacccatgtaccaggtcccaagccctatcgccggtattgcctgttgacctgccacgttaacgtattttgccattttacgctcctgcactgttatagggcagacaaactaacagagggcaacgcctgccctcttaaggtgcaaatcagaaagtgtaacttacgcctgtccagatcgtgaactgtccacttttatcaaccatgggactgtctttgatttcactggcaaaacgggtgtagcgtcctgacaggttagcattccactgtggcgtaatgctgtagctggcattcagctccgcataaggtgaccagctgtcatcgggatgatagcggctgataccggtacgatcgctctcatggccagatacgccatagtagtaacggttctgattcgcgctgttccacatggctccaatccccggcgttaacgtaaaatcgccgaagttaaagcggtagaggtaggtaagatcccagatgatgccattactgttgttgagtacgtcaccgagcagtgaagtacgaacaatcccccagtctgcggtatgtctgtaggtcgcaccgcccatcagcgtcatgcggcgcttatccagccctttcatatcgcccagatcgttgtcacccgggtcatattcttgtggtgagcccagcaacgtcagagacagctgatcctgagggtctttccacaggtagtaaccgccctgtagcgtgttaaaccagaagttttctccttcataattgatgatgggcacgggcaaatagcggtcctgcccaccccgatacggggattgcgcataaatcactgatgcaccgagtgataaaggcgcggcctgaactgcctgccccagaaaataacaagggagaagtgcgataagcgtgttaagtttgaattggttcacaatttattcattccataaatataacaatcactcatacagtctaacgctttttacagactgaattaaccttatatgaaaatcatctacccaatttaaggcaggatgtggcataaccgggttagagacatcacaaatttgccatttatgcgtcaaaaaggtttcgcaacaaaatgattttgttattgatatgtggctcactaatcaaaaatctatgatgaaatttcctgaatgccttctacagttaaacttaataccgagggttttgttgaaagagagtaaccataaaagttgtgcatcccgataacaatgatcaggttggcataagggttgctgtagcaaaagataatatcttccgggagctgtacgagcactgattattgctcctttacctgtgctaaaaacgaaaggacgggcatcgctatgaatatattcgatcattatcgtcagcgttatgaagctgccaaggacgaagagttcacactgcaggaatttcttaccatctgtaaacaggatcgcagtgcatacgccaacgccgcagagcgactgttaatggctatcggtgaacccgtgatggttgacaccgctcaggagccacgcctttcccgaatcttttctaaccgggtgatgggacgttacccggcatttgaagagttttacggtatggaagaagcgattgaacaaatcgtttcttacttgaaacatgcggcacaaggccttgaagagaagaaacaaattctttatctgctgggtccggtcggcggcggtaagtcctctctggctgagcggctgaaatcgctgatgcagcgtgtgcccatctttgtgttgagcgccgatggcgaacgcagcccggtcaacgatcatcccctgtgcctgtttaatccgcaggaagacgccaatattctggaaaaagagtacggcgtaccccgccgctaccttggcaccattatgtcgccatgggcggctaaacgcctgcacgaatttggtggggatatcacccgcttcaaagtggtgaaagtatggccgtcgattctggagcagttagccatcgccaagaccgaacccggtgatgaaaacaatcaggatatctccgcactcgtcggtaaggtcgacattcgtaaactggaaaaccatgctcagaacgatcctgacgcctacggttactcaggtgcgttatgccgggcgaaccagggcatcatggaattcgttgagatgtttaaagcacccatcaaagtgctgcatcccctgttaaccgccacccaggaaggtaactataacggtacagagggcatctctgctctgccgtttaacggtatcattctggcgcactcgaacgaatctgagtgggtgacgttccgtaacaacaaaaacaatgaggcgttccttgaccgtgtttacatcgttaaggtgccttactgcctccgcgtatccgaagagatcaagatctacgagaaactcctgaatcacagtgagctgtccacggcaccttgcgcgcccggcacgctggaaactctggcgcgattctccattctgtcacgcatgaaagatccggataactccagtatctactccaagatgcgtgtatatgacggtgaaagcctcaaggataccgatcccaaggcgaagtcctggcaggaataccatgactacgccggcgtagacgaagggatgaacggattgtccacccgtttcgcctttaaaattctgtcccgcgtctttaacttcgatcatgctgaagtggcagccaaccctgttcacctgttttacgtgttggaacagcaaatagaacgtgagcagttcccgcaagatcaggcggaaaaataccttgagcacctgaaaggttatttaattccgaaatatgcagagtttattggcaaagagattcagacggcttatctggaatcctattccgaatatggtcaaaatatctttgaccgctatgtcacttatgccgatttctggattcaggatcaggagtatcgcgatcctgatacagggcagctgtttgaccgtgagtcacttaatgcggaactggaaaaaattgagaaacctgcggggattagtaatcctaaagatttccgtaatgaaattgtcaattttgtgctgcgtgcacgggcccataataacggccgcaatccgaactggaccagttatgagaaactgcgtacggtgattgagaaaaaaatgttctcaaataccgaagagctgttgccggttatttcgttcaatacgaaaacgtccacggatgagcagaagaagcacgatgattttgtcgatcgtatgatggaaaaaggctatacccgcaaacaggttcgcctgctgtgtgaatggtatctgcgcgtacgtaaatcgtcctgatcagagtctgtaagcaaaccggtgcgggatagcaccggtcacttaaggacgggacagcccggcctgcttgcaatgtagtttgggggaacatcatggcctattttatcgatcgccgactaaacggtaaaaacaagagcgcggtcaaccgccagcgcttcttgcgtcgttataagtcccagattaagcagtcgatctccgaggccatcaacaaacgctcggtgaccgacatcagtagtggcgaatccgtttccatcccgattgatgacatcaatgaaccgattttccatcagggtcgcggcgggcaacgccatcgtgtccatccgggcaacgatcactttatacaaaatgaccgtgttgagcggccgcagggcggcggtggcagcggttccggtcagggcaacgccggtcaggacggtgaaggtcaggatgagttcgtttttcagatctccaaagatgaatatctggacctgctgtttgaagatctggcgctgcccaacttgcgtaaaaatcagcaccgccagttaaacgagtataaaacccaccgtgcgggttttacctcaaatggtgtgccggccaacatcagcgtggtgcgctctctgcagaactctctggcgcgtcgtactgccatgaccgcaggtaaacgtcgccagctgcatcagcttgaagatgaactcgccacggttgaaaagtcagaaccggctcagttgctcgaagaggagcgcttacgcaaagagattgccgacttgcgtgcgcgtatcgctcgggtgccctttatcgatacctttgatttacgctacaaaaactttgaaaaacgccctgaaccttccagccaggcggttatgttctgcctgatggacgtctcgggctccatggatcaggctaccaaggatatggcaaaacgcttttatattttgctctacctgttcctgagccgcacttacaaaaatgtcgatgtggtttatatccggcaccatacacaggccaaagaagtcgacgagcaggagtttttctattcacaggaaaccggcgggaccatcgtgtcgagcgccctgaagctcatggatgaagtggtcaaagagcgttacgatccggcacagtggaatatctacgctgctcaggcgtcagatggcgacaactgggcggatgattcaccgctgtgtcatgagattctggcgaagaacatcttaccggtcgtccgttactacacctatattgaaatcacccgtcgtgctcaccagaccctgtggcgcgaatatgaacacctgcagtcgatattcgataactttgcgatccagcacattcgtgaacccgaggatatctacccggtgttccgtgagctgtttcacaagcaggcaatggaagcctgagacacgaagccgacgccctgtcggcttttttttgtctaataacctgttaaaacatggccttccccgtcacaaaccctccaactactctattaatatcgttaaactggagtaacaaaggcattagcaattgatataaattgcataatgaccatgacaactcattgataaaacattatcttgcagacatagcatgggtgtttctacacattagctaacattgattgccgtatctcaggagaccgggtttgaaccacactattgtttatagtctttttattattgggtccgtgctggttgcgtcgagtatcttactcagttccttttcatcccgtctgggcattcctatcctggtcattttcctggcgctgggaatgttagccgggattgatggcatcggcggtatcgccttcgataactacccagccgcttacctgatctctaaccttgccctggcgattattctgctggatggcggaatgcgcaccaaagccagctcgttcaaggtggcgctgggcccggcactgtcgctggcaacggtaggcgtcattatcacggctggattaaccggtctggtcgccgcatggcttttccggctcgatatgatgcagggctttttaattggtgccattatcggttccaccgatgcggcggcggtgttctcactgctgggcgataaaggcctgaatgaacgcgtaagctcaacgctggaaattgagtctggcagcaacgatcctatggcagtgtttctcaccattacgctgatagagatgatcgagcagggcaaaaccggccttgactggatgtttgtggtacacctgattcaacagtttggtctgggcattgtgctgggcctgggcggcggctgggccctgcagcagctgattaaccgcattaacctggctcctggcctttaccctttactggcactcagcggcggtattctggtgtttgccctgaccacggtcctggaaggcagtgggattctggccgtgtatctgtgtggtttcttgctcggcaacagccctatccgcaaccgctttggcattctgcaaacctttgatggtatggcctggctcagtcagataggcatgtttatcgtgctgggcctgttagtcacgccgtcggatctttggcatatcgcggtcccggccatgattctctcgctgtggttgattttggttgcgcgccccctgtccgtcttcatcggcttattgcccttccgtggcttcaccgggcgcgagcgggtttttatcagttgggtgggcctgcgtggcgcggtgccgattatcctggcggtgttcccgatgatggcgggcctggaaaacgcgtcgctctattttaatattgccttctttgtcgtgttggtctcactgatgctgcagggcacctcgctgggatatgccgcgaagaaagccaaagtggtggtaccgcctacggcgtcgcccatcagccgcatcgggctggatatccatccggaaaatccctgggagcagtttgtctatcagcttagtgccgacaaatggtgcgtaggcgccgcgctgcgcgatctacagatgccgcgtgaaacccgtatcgccgccctgtttcgggataacgtgttgatgcatccagatagcgcgacgcgtttaaaagaaaacgacgtgatttgcgtcattggtcgtgagcgtgatctgcctgcgttgggaaaaatgttcagccagtcgccgcccgtctcgctggatcagcgtttcttcggtgactttattcttgatgccgacgctcgcctgaacgatgtggcgcaaatatatggtcttgaactggatgaacacaccaacgcgcaacaatcactgggacaactgatgctcggcatgctcggcggcacgcccgtcgtaggcgatcagattgaatggaatcagctcacctggaccgtggcggaaaaagaagataatcaaatcgtgaaaattggtgtgcgcccaagtgaagacaaggaataatcttaattaattggcgcggttaattggctgaattgcactaagcttttatgacattcagttaaaacgggagttatccatgggtcacgtggttaaaattggtcgctacgaaattgtcgatgcagaattcagcagcgaagaacctgtgacagtgagtattccctgccacaccaaccccggcctgagttatcagctcgacggctgggatcatgacaccagcgttcctgcctggattgatgaccaggaagtcatcttgcacatcgggcattacgataagcaacaagaccgctgggtattaaaaaaatcagcatgatcctgtgaattgccgccagacagtggatttggcggtaattcctaaaaaaagcccctgtacgcactgctcataagttatactttttaaatattatctttcaaattagccacttaaacaaaactcacgcgattatcgcctggttttttaagaattattccgtattaactctgtcaaatatctcctgcatactcttccccagtgctgcatttttacgtgactcaactcacgcttagcgaaattttttcttgcagcgttaatggctctaatgactgtaacaaactgaaaacatcccggttttggattttcagtcgttaacccctgaacgcgtacttgattctggtcaggccatcttttacttaattaagagagcaggttttatggcaagtacaatggtaataaacaatgcgagtcgctcatggagcggtcttcgtaagaatattcttgtaaagtttgcactcagtttttccgaccttattgcgctgaatttagcgctgtttctctctgctgccactattcagggtatttggggagatcttgatgcgtttattccaccgcatcaaattgaaaaccgttttattgcgcagtttattatgtcggtattatgtactggctggttttggatgcgtctgcgtcactacacttaccgcaaacccttttggttcgaactgaaagagattatcaaaacactggttgttttctctctgctcgatctggcattaatcgcgttttctaaatgggacttttcccgcatggtgtgggtgttcagttggagctatgccctgcttctgctgccgctgatgcgcgccggcgtaaaaaaagccattaataaagccggtcaatggaaaaaagagaccatcatcattggttcaggtcgcaacgccaccgaagccttcgcggccttacaaagtgaagaaattctcggttataacgttcaggcgtttatctctgtagaagacgcgccgcagcagcagagtgttaatggcgtgcccgtcatctcggcgaaggatatcaactggaacaccatcgaccgtgacaatgtgcagtttattgtcgcgatggagtatgagcagcaaccggaacgcgaccgctggttgaagtttttatccaaaatgaactgccgttccgtgtcagtgatcccgaccttacgcggcgtgccgctttacggtacggacatgtcgtttatttttagccatgaagtgatgattctgcgcgtaagtaataacctggcgaagcattcctcacgcttcctgaagcgtggcttcgatattgtggtggcatcattgctactgctcttccttgcaccggtcttcggcctgctttgctacatggtcaagcgtgacggcggcaatgcgatttacggtcacgaacgtatcggccaggatggcaaaaagttcaaatgtctcaagttccgctcgatggtcacgaattccaaagaggttctggaaaaactcctggcgaccagcgaagaggcacgccgggaatgggacaaagactttaagcttaagaaagacccacgcattacaggcattggcggcttcctgcgtaaaaccagtcttgatgagttaccgcagctctggaacgtgatccgtggcgaaatgagtctggtgggaccacggccggtgattgaggctgagcttgagcgttatgccggcgatgtggattactacctgatggcaaaaccgggcatgaccgggttatggcaggtcagcggtcgtaacgatattgattacgatacccgcgtctattttgactcctggtatgttaaaaactgggcgttgtggacggacatcgccattctgtttaaaacggcgggcgtggtattccgccgcgacggcgcttactgatgtagccagcgatgcctgtttcggacaggcatcgcgatttcgcccggtaattcgctttccttttgtcctgttaatcattaccctcttccctcgctttatcgaacgtttaccctctggttgctatgcaaaaatataccttattgttattgagcctggtgttactggcacctttaggcatcgatctctatttaccgacgctgccccagattgccgaaggcttatcaacacctgttgccctggtgcaaacgactatcccactctttttgctggtgatgggcctggggcaactggtcagtggcccgctggtggacaactatggacgtaagcccatcgccttgctgggcctggcgctctatattgcgggcagcgccatcgccgccacggcgacctctttcccgctgtttttactggcccgtctggtacagggttgcgcggtatgttgcagcgcggtggtagcctttagcggcgtgcgcgaccgactgagcggcgatgatgccgcccgggcttatggcttcctgaatggcgcactgaatattgtgcccgcactggctccgttactgggtgggctgttggccagcgcctttgactggcgagcgcccttctggttcctgtgcgcttacgcggcagtagtgatgctgatggttatcgtctggctccctgaaacgcgcccggcggatacgctgcgcgttaaaggccttcccgtgaatcagtacgccaccattctccgtcaacctcgcttcctggcctttgcttttgccaatgccggtgccggtgccctgggcatggtgctgacctatgtatcactggccccacaggtattaatgaccgaaggcggtctgtcccctctggctttctctttcgccttcggcgccaatggtttttggatcatgatggttagcgtggtggtgaataaagcgattcgtaaagcgggccgaccgttttgcctggccatcggctttattacgatgctaacgggtgccgtgctgctggtggcaggcatgacgttattccctgcgagtatgcaatcccactgggcgctgtatatgtttccggtcgcggttgccgtcgctggcctggccttcaccgttgggccagccaccagctatgcgctggagccctatcaacagcaggcgggcgtcgcttcagcgctacaggggtttattcagatggcgggaggcgcagcaggcagtctgatcgtcgtagccctgccgatggcagaaaagctgtcgctgacattgatgatgctgctgggcgcagcgctggccttcctggcctggcgctgcagcaaaaacatgcaaagtcgtattaccgctgttaaataagcttaaccggaacgcggggggccagtgcgcacatgagctcatagcccacggttccggctgctttcgccacctgatcgattttgacgttttcgccccataactcgacagacgagccaatgccagcctgcgggcaaggcgtgagatcaaccgtaatcatgtccatagacaccgcgccgacaacctgcgtcataatgccgtcaacagcaaccggggtgcctgtcggtgaatggcgcggataaccatctgcatagccgcaggctaccacgccgatacgctgtggctgctttgcatgatagcggtagccatagcctacgccatctccagcctgaagttgctgcacgccaataatctcactggtgagcgtcatcaccggcttcagaccactgctggcgatatcctgccagtcaccgcttggtgaggcaccgtacagtatgatccccgggcgcacccagtcgtgatgtgcttcgggatgccacagcgtacaggccgaattggacaatgaaagcgggctttccagcccttccgtggcctgcgcgatgcgctttaacggttcgacaataccgtcaggattttccgcatcggcaaagtgcgccatcaacgtgatatccccgacgttttcaatcgcacgcagtttatgccagatcccattgacctgctcaggacggaaccccagacgattcataccgctgttgatcttcagataaatatcaacaggcgcagaaagcgtggcattggccagggcgtgaatctgccagttgctgtgcacactggtggtcagccggtagcgatcgattaatgccaggtcatcaggatgaaagaacccttcgagcagtaatatcggctttttccagccctgctcgcgcaacataatggcctcttccatgttaagcagagcgaaaccatcggtcgctgacaggctttcccatacgcgggcaatgccgtgaccataggcattcgctttgaccactgaccagatgcgtgacgcaggagccgcccggcgcgcaatcgccaggttatgtcgcaacgcgtgttgatcgatggtagcgacaattggacgtgacatacttcctctccctgaaggcttaacgggtagcgttaacgttgcgaagcggcgatcggctggccgcaaaaccgggtaaatagcgaaagacggtgagatcatctgcggctatcgcggatgatgttccggacatgacgtcagcgagtaactgaccggaaccgcacgccattgtccatcccagtgtaccgtgtccggtattcagataaaggttcgagagcggcgtagcgccaaccaccggcgttccatctggcgtcatagggcgcaggccggtccagaaactcgcctggctgacatcaccgccttcaggataaaggtctgtgaccaccatctccagggtttcacgacgcgcctccagcagtttggtgttaaaaccaacaatctcggccatgccgccgacgcgaatacggttatcaaagcgcgtcactgccactttgtaggtttcatcaagaatcgtagaaaccggtgccgcatcgggattggtcaccggaatcgtcagggaatagcctttaagcggatagacgggaatatcgacgatattcttcatcagcgaggtcgaataggaacccagcgccacgacatagctgtcgcctttaatcacttcctcaccgcacttcacgccataaatacgattgccgtcgcgtagcaactgatcgattggcgtattaaaacggaagacaactccggcttcttcggccattttagccagacgttgagtaaaaagttggcaatccccggtttcatcattcggcaggcgtaatccgccggtgagtttatggtgggtcgccgccagtgcaggctcgacgctggacagctgatgcgcctccagcaactcgtagggcacgccggcctcgcgcagtacagcaatgtctttactggcgctgtcaaactgctgctgggtacgaaacagctgcagcgtgccgccctggcggccttcgtaggcaatgccggtttcggcacggagcgctttcaggcaatcacggctgtattctgccaggcggaccatgcggcttttgttttgctggtagtgacgcatatcgcagttgcgcagcatgttccacatccattcgagctgaaagcgactgccgtccagccgtattgccagtggagcatgacgctggaacatccatttcattgccttcagtggtacacccggcgccgcccagggcgcagcatagcccggagagatctgtccggcattcgcggcgctggtctccatagcgggctgaggctgacgatcgatcacggtgacctggtgcccggcgcgcgccagataccatgcgcttgttacgcctactacgccacttccaagaatcactacgtgcataagtcccccgcgaaattaaaaagcataatccactgttcactggtttacattcagtgtgatcacaaagtggaaacatcctctaaacaattcaactatttcacctctttttccgtcagcaggtaactaaaatcatttcacagactgaaattcagagatttatgcgccctgatgcaaaaaatcaggcataaatgacattgtttatagttaattcctcctattgcaggagaatcatttgacgcgcgcctttatcctaaaaagcagtgctttatgctaaaaaaaacccacagcgcagcaagtagggctatttaatcccaaccctttcaacctgaaatgatttttctgccaaagaattcgtttgagttccccgatcagataagcgacagtgaactatcattgatatgttcactcagtttttttgggtttcctttctcaggaagagccttaaataaatcgtaacgggcagccagtcagcgttcgctcgttcgccaaaacagaggtgcgctatgaccacaatctttgacgattccctcatggacagcaaacgaattagcgatggtcctgactggacattcgaattactggatgtctatctggctgaaattgaccgtgtagccaaacactacggtctggacacctacccgcaccaaattgaagtgatcacctcagaacagatgatggatgcctactccagtgtcggcatgccgattaactactcgcactggtcattcggcaaaaaatttatcgagaccgaacagcgctataaacacggacagcaaggcctggcttacgagattgtgattaactccaatccctgtatcgcctacctgatggaagagaacaccatgaccatgcaggcgctggtgatggcccatgcctgctacggacataactccttctttaaaaacaactacctgtttcggagctggaccgacgccagctccatcgtcgactatttgctgtttgctaaaaattacatctctgactgtgaagagcgttacggtgtagaggaggtagagcgcctgcttgattcctgccatgccttaatgaactacggggttgatcgctataaacgtccgcagaaaatctcgctgcaggaagagaaagctcggcagaaaagccgtgaagagtatttacagagtcaggtgaatacgctgtggcgtacgctgccacgacgggaaaaagaagccactcagattgaagcggcgcgttacccgtcagagccgcaggaaaacctgctctactttatggaaaagaatgccccgctgcttgaatcctggcagcgtgaaattttgcgtatcgtccgtaaggtgagccagtatttttacccgcagaaacaaacccaggtgatgaatgaaggctgggcaaccttctggcactacaccatcctgaatcacctctatgatgaaggcaaagtgtctgaacgctttatgatggagtttttgcacagccataccaacgtcatttttcagccgccttataacagccagtggtacagcgggattaatccgtatgcgttaggctttgccatgttccaggacatcaaacgcatttgccagtcgccaaccgaagaagatcgctactggttcccggatattgcgggttctgactggcttaaaacgatgcattttgcgatgcgtgaatttaaagatgagagctttatcagccagtttctgtcgcctaaggtcatgcgtgacttccgtctgtttaccgtgctggatgacgatcgtaataactttctggagattgcagctatccacgatgaatccggctaccgcgccgttcgccagcagctttcggcgcagtacaacctgagtaatctggaacccaacatacaggtttataacgtcgacttacgcggcgatcgttcactgacgctacgctatgtaccgcaaagtcgtgcaccgctggataaaagccgccgggaagtgcttaagcacgtccatcgcctgtgggggtttgatgtgattctggaacaacagaatgaagacggaacggtagagctactggaccgaaatccaccgcgtaactccccgctgtaaatggacaaaaaaaaaccggacgtcacgtccggttttttattaacgcttgctgcctaaatcgtcaggcatcgttttttgcattgaatgccagatatcaccgctctgacggccatagcggcgcacgcactcgacgatttcgtcctgagtgggctctttatcacacagggcaagcagcgtctgatagaaatctctggccactttgcgggcttccggattagaaaagtagtgtcgtccaacccgggtatagagcccttttagcccgttcaggatcaggccatagattgggttgccggaggcaaacgccaggccacggaacaccttgtaatccagttcggtatagctatcgacctggtcttcagcactattaacggcctccagcacttcgcgtgccttctcaggataatggcgtaatgcgcggctaataaagatagaggaaatattggtgcgaacggataacaggttatcgatcagtgcgggcacgctgtcgtgatcgagtcgcgccagggtttcaagaatattaagacccgaggtttcccagaagttgttaacgcgcgtgggtttaccgtgctgaatcgtcagccagccgtcacgtgccagacgctgtaacacttcacgtaacgtagtgcgcgtcacgccaatcagttcagaaagctcacgttcagcaggaagaatcgatccgggtggaaaacggctgttccagatgctttcaattatatactcttcagcaaatccggctggactctgcgccttaataaccataactgtgtgttctcattgctttctggatcgtaatgggcactcatcataccagacgccctatagcggatatagcctgcacaacgattaaaagcgcggtttagcaaaaaattaagacagattaccctgataatctttgacgccatttaagcccgaatcacacctcatttttgcgcctgccccaccgcaacggctgcggtcttgcctatccggtttagcgccaccgacgaacagcaataacatgctgtgtggcggtttgcgtgaggtcattaatctggagcagtgtcaggtcatgtttgtacatgattttttatccacgcaggatggcgtgcagcgacttttggtttacactgcgggcttgacgtttacagggaatgcaatatgttgcgatatttaaaccaatgttcgcgtggtcgcggtgcctggttattactggcactcacagcactggccttggagcttacggcgttatggtttcagcatggtttgggcttcaaaccctgcgtaatgtgtatttatgtccgctgcgcgctgttcggcgtagtggcggcaggcgttatcggctttcttctgcctcgctcaccgttacgcctggtggcgattctggtgtggatttacagcgcctggaaagggctgcagttgtcttacgaacacacgatgatcctgctgcatcccaatccctttgtgacctgtgatttcgctgcgcgtttcccgacatggttgccgctggataaatggctgccgtcggtatttgttgccagcggggattgctcagatcgcggatgggattttctgtctctcagcatgccacagtggatgatcggtattttcgccgcctatctgttggtcggcgtgctggtactgatcgctcagccgttgaaacctaaacgccgcgacttatttggtcgctaacgtaaaaaaggctgccgctggcagcctttcgtttatgtgcatcatccgttccgatctggccggtcgataatatgatcttcccagtcgcggacttcactttcccgcacggcaatgtagcgcaccgaaatgcgctgagcgtgcatctcggtttttgaccctgcgcgcagcgggtgccaggccggtagcggtttcccctcgcccaggagtcgataggcgcaggtgcgaggcaaccagttaaaggtcgtcaggttttcgcgcgtcagcttgatgcagtcttcttcatattcaaaccggcgctcgtaattgcgacactggcaggttttgatgttgagctggttacaggcgacgttggtgaaataaatttcatcggtatcggcgtcctgtaacttgttcagacagcactggccacaaccatcacacaaggattcccattcctcatcgctcatttgtgccaggcgcttgtgttgccagaaaggggtttcagtcatgatggttgtccagatttagcataaaccgcaccttataaagatattggcccaatgatgcaagttttacagtacccgcgtgctgatgccatggcccgcgatggaaacctctaacgtatcgccagcgtgcattggcccaacgccttctggcgtaccggtcaggatgacgtcacccgcgtgcagggtaaaatactggctcatatgggcaatcagcggcaggattttgtgaatcatatcggcggtattgccgtgctgacgaacctcaccgttcacgaccagcttcagttcggtgttctgtggatcacctgaaaattccgcagttggaataaaacccgacagaggacaggcgttatcaaaggctttcgctttttcccagggctgcccggctttttttaagcccgcctggagatcgcgcagggttaaatctagtgccacaccataaccggcaatggctttggccacatgcgcgtctgaagcctgtttcagggtggtgccaatcagcaccgccagctcaacctcatgatgcacttcaccaaacgcatcaggaatcgataaaggctgacgcatatcgcataaggccgtttgcggtttaataaaaattaccggttcggtcggtgtcgcactgcccatttctttaatgtgcttcgcatagttactgccaacacacaccactttacccacgggataatctaacaaagcgccttgccagttacgatgctgatacatgctaatcccctgcttatgttaccgaaatgtcagccatatcggcgggttgacgttacggacagacggcacgcaaagccagcctgttcataacggttaagagtggttaaacctgacagatgcgtgaaaattgtcaacaagtcagccaggctatttgtgcgtcaccgcgaaccgatgaccgatcggattgcacggaaaaagcaaaaaaacagcggtgctgcacaattattattcaccccggctgggaatataaattggccgccgaccgtcgcgcaaaatttatattaaaggaacaatccgagttaatcttttctgtcgtgttcgagatgcgtttttaacaaactttcgatcggtgggggaatttgcaaataatatccctgatcgcttaaaccctgcttaacgttattgatgtctgcattagccagtttgtcgcgttgggcaaggtttaccaccatcgcgagttgcggcttaccaaagcctttgagcagggcgtcaggaacgcgtgaaaaatcgtcctttttttcaacgtagagataagttcggtcgcggaccggacttctgtagatcacacaaaacatattttttactcgaattaaccagcgctgaggcttgtttgaatatagcggtaactataacatgcttgcagtacttcgaatattcgccgatcgcgctttaacgatgcttttatcatcgcttagcacagggtagtaaaacaggactgagtcgggacagatgccgcaatcgccaatcgaatttaagggaagcagttttaccttgtccgtcgttcatttgcatcaccatgagccagaggtgatccgcaaagcgctccaggacaaaattgaccaggctccagatttcctgaagaacgcacccgtggtgctgaatgttgcggccctcgatgccgcggtgaactggaaacagatgcagcaggccgtgagcgaaacgggactgcgtatcgtcggggtcagtggatgcaaagatgatgcgctgaaaaaaatgattgcccgcgtcggacttccggtgctggctgaaggcaaagagagccacaagcgtgacgcgcaggagccggaactcaagcccgctgcagccgaaccgctggtagcgaaaacacgcatcgttaacacgccggtgcgctctggccagcaaatttatgcccgcaatgcggatttgatcgtcaccagcagcgtgagcgccggtgcggaactggtcgctgatggcaatattcatatctatggcatgatgcgtggccgtgctctggcaggtgccagcggtgacagcgattgccagattttttgcaccaaccttgcagcagagttggtttctatcgccggggagtactggatcatggatcaaatccccgaagcgttttttgctaaagcagcacgcctccgtcttcaggatggcgcgctgactatacagacacttaattaggccccttttctttcgttaaggaaatcaacatttatggcacgcattattgtagttacatccggtaaagggggcgttggtaagaccacgtcaagcgcggccatcgccaccggtttagcgcagaaaggcaaaaaaacggttgtcatcgactttgatatcggcctgcgtaaccttgatttaatcatgggttgcgaacgccgggttgtttacgattttgttaatgtcattcagggtgatgccacgctgaaccaggcattgattcgtgataagcgcactgagcaactttatattctgccagcctcacaaacccgtgataaagacgccctgactcgtgaaggtgtcgaaaaggtcctgaacgatcttgcagagatggcgtttgatttcatcgtctgtgattcgccagccggcattgaaaccggggcattaatggcactgtattttgcagatgaagccattattaccacgaacccggaagtctcctctgtccgcgactctgaccgtattctcggcatcatctcttcaaaatcccgccgcgctgaaaccagccaggaaccggttaaggagcatctgctgctgacccgttataacccgggtcgcgttaatcgtggcgatatgctgagcatggaagatgtgctggaaattctgcgcattcctctggtcggcgtaatcccggaagatcagtccgtacttcgtgcctctaaccagggcgagccggtgattctggacggtgagtctgatgctggtaaagcctatgccgataccgttgaccggttactcggtgaagttcgccccttccgctttattgaagaagagaagaagggtttcctgaaacgcctgttcgggggataaaccatggcattacttgatttctttttatcccggaagaagaacactgccaatatagccaaggaaaggctacagattattgtggcagaacggagaaggggcgacagtgagccccattatcttccgcaacttaagcgcgacattcttgaagtgatttgcagatacgtgaagattgatccggacatggtgacggttcaactcgatcagaaaggggatgatatctccattcttgaactgaacgtcacgctacccgaaacggaagacgtgcctaaatgacgtcaaccgtttcctgactttcccctgcgcagttgcaggggaaattttttacagcccggcaaggatgtcggtaataccgggtttcagcaactcgccacgccagcctgttaacagctcgggttcgcggttctgtggcttaagcccccagtgctgacttaacacctgattgatctggcgacgagacgccagcagttcctgactaaaaccactctgctcactcacctgctgtaccagcgctttgattgccttaaacgcccgcttgtaattcacatgatccaccagattgcttaacggcggcggtaacgcactctcatccagctcagcggcttctgccacctgcgccagcatcgccctgccgtggaaacgaatctcatggcccgataagcccagatgatctaactcaccctgagaacccggcataaaacgtgcgactttccacaggttctcttcacgcaccacaaaattgaccgccatgtctttttcacgcgccactttcaggcgccatgccgccaggcgttgcagcgccgccagctggcgcggacgcaactgccaggcgttagtgatatcacgccacgcatcctccggcgctaacgtatccagccgacgctgacacaggttttcgcattcactcagtgccgcggccatattaccggcctgctccacctgctgtatcagttgatgagcaatcggcagcaggtaatgcacatccgccgccgcatactggcactgccgttccgtgagcggacgggctaaccagtcggtccgcgcttcactcttatctaattcaacctgcgtaaagtgcgccaccattgaggcaaatccccaggaaagcggctgaccactgaaagccgccagaatctgtgtatcaatcatcggctgtggcaggacaccgaaacggtgcaggaacacttccagatcttccccgcccgcatggagaaatttcgtcacgcgggtgtccgttagcagttcaataaacggtgaccagtcacgaacgggtaacggatcgatcaacactaactgttcgccatcaaacagctgaatcagtcccagctgcggatagtaagtacgggtacggacaaattcggtatccagggcgacggccgtatgctggcgtgctttgtggcacacctcggccaggtgatcatcgttctcgatcagggaatagttcacgttcagttttcaccgcagccgacaacgtgcggtgctccatgttaaaagcaataaaaacgccggacagcgccggcgttcaacctgaatcctgacggtgaatcagcctgtgctggttttcacctcgtcgcgcagttcgcgacgcagaatttttcctacattggtttttggcagttcatcgcgaaactcgacgattttaggcactttatagcccgtgagctggcgacgacagtgatccagcagttcttctttggtcagcgagtgatcttttttaaccacgcagactttaacggcctcgccggacagctcgctgggcacgccaatcgctgccgcttcacgcactttgggatgctgcatcaggacatcttcaatctcattaggatagacgttaaagcccgacaccagaatcatatcctttttgcggtccacgatacggataaatccttcgggatcaacggtaacaatatccccgctatggagccagccatttttcaggacttctgctgtggcctccgggtgctgccagtagccgagcatcacctgagggccacggatgcacagttcgccaggctctccggtaggcacttcgttcccactctcatccagaataatcacgtccgttgagggcacaggtaatccgatactgcccgtgtgacagctgatgtcataggggtttaccgagaccaggggggaacattccgtcagaccatagccttccagcaaatagtgtcctgtgagcttttcccagcgttcagccaccgctttttgtactgccatgccgccgcccgctgaaaggcgtaacgtcgagaagtcgagtttgttaaagttgtcgtcattaagcagcgcattgaacagcgtattcacgccggtaatggcggtaaacggatatttgg
